(12) United States Patent
Chenchik et al.

(10) Patent No.: US 6,352,829 B1
(45) Date of Patent: *Mar. 5, 2002

(54) METHODS OF ASSAYING DIFFERENTIAL EXPRESSION

(75) Inventors: Alex Chenchik, Palo Alto; George Jokhadze, Mountain View, both of CA (US); Robert Bibilashvilli, Moscow (RU)

(73) Assignee: Clontech Laboratories, Inc., Palo Alto, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 09/225,928

(22) Filed: Jan. 5, 1999

Related U.S. Application Data

(63) Continuation-in-part of application No. 08/859,998, filed on May 21, 1997, now Pat. No. 5,994,076.

(51) Int. Cl.[7] .......................... C12Q 1/68; C12P 19/34; C07H 21/02; C07H 21/04
(52) U.S. Cl. .......................... 435/6; 435/91.1; 435/91.2; 536/23.1; 536/24.3; 536/24.31; 536/24.33
(58) Field of Search .......................... 435/6, 91.2, 91.1, 435/24.3; 536/24.31, 24.33, 23.1

(56) References Cited

PUBLICATIONS

Ehlers et al. J. Exp. Med. 173:25–36. Jan. 1991.*
Chalifour et al. Analytical Biochem. 216:299–304, (1991).*
Wei et ala. Cancer Research (Nov. 1, 1995) 55(21) 5025–9.*

* cited by examiner

*Primary Examiner*—Jeffrey Fredman
*Assistant Examiner*—Juliet C. Einsmann
(74) *Attorney, Agent, or Firm*—Bret E. Field; Bozicevic, Field & Francis

(57) ABSTRACT

Methods and compositions are provided for analyzing differences in the RNA profiles between a plurality of different physiological samples. In the subject methods, a set of a representational number of distinct gene specific primers is used to generate labeled nucleic acids from each of the different physiological samples. The labeled nucleic acids are then compared to each other and differences in the RNA profiles are determined. The subject methods find use in methods of identifying differential gene expression.

10 Claims, No Drawings

METHODS OF ASSAYING DIFFERENTIAL EXPRESSION

CROSS-REFERENCE TO RELATED APPLICATIONS

This application is a continuation-in-part of application Ser. No. 08/859,998, now U.S. Pat. No. 5,994,076 filed May 21, 1997, the disclosure of which is herein incorporated by reference.

INTRODUCTION

1. Technical Field

The technical field of this invention is the analysis of differential gene expression.

2. Background

In higher organisms, any given cell expresses only a fraction of the total number of genes present in its genome. The small fraction of the total number of genes that is expressed determine the life processes carried out by the cell, e.g. development and differentiation, homeostasis, response to insults, cell cycle regulation, aging, apoptosis, and the like. Alterations in gene expression decide the course of normal cell development and the appearance of diseased states, such as cancer. Because the choice of which genes are expressed has such a profound effect on the nature of any given cell, methods of analyzing gene expression are of critical import to basic molecular biological research. Identification of differentially-expressed genes can provide a key to diagnosis, prognosis and treatment of a variety of diseases or condition states in animals, including humans, and plants. Additionally, these methods can be used to identify differentially-expressed sequences due to changes in gene expression level associated with predisposition to disease, influence of external treatments, factors or infectious agents. Identification of such genes helps in development of new drugs and diagnostic methods for treating or preventing the occurrence of such diseases.

One way of analyzing gene expression in a particular cell is to perform differential gene expression assays, in which the expression of genes in different cells is compared and any discrepancies in expression are identified, where the presence of discrepancies indicates a difference in the classes of genes expressed in the cells being compared.

One method currently employed to identify differentially expressed genes begins with the generation of cDNA "targets" obtained from analogous cells, tissues or organs of a healthy and diseased organism. The cDNA targets are then hybridized to a set of target nucleic acid "probe" fragments immobilized on membrane. Differences between he resultant hybridization patterns are then detected and related to differences in gene expression in the two sources. In this procedure the number of analyzed gene-specific probes can reach several hundred thousand.

Modifications have been made to the above basic method in order to obtain improved results. These modifications include replacement of the traditional radioactive labeling procedure of the target nucleic acid sequences with nonisotopic labels, mainly fluorescent labels. Other modifications have focused on improved methods of immobilization of an array of the probe nucleic acids to surfaces of a variety of solid supports.

Despite the promise of analysis of differential expression using arrays of probes on solid supports, there is a continuing need for improvement of the methods currently employed by researchers. In current methods, hybridization of "target" to "probe" is slow. Furthermore, a number of additional events such as competitive hybridization events between distinct target sequences, nonspecific binding between "target" and "probe," and formation of secondary structures in target sequences can occur which adversely effect the results.

Accordingly, there is continued interest in the development of new methods of analyzing differential gene expression, where such methods provide for fast hybridization and high specificity of binding of "targets" to "probes."

Relevant Literature

Patents of interest include: EP 0 328 829 B1 and U.S. Pat. Nos. 5,468,613; 5,580,726; 5,599,672; 5,512,462; 5,162,209 and 5,162,209. Methods of analyzing differential gene expression are also described in Maniatis, et al., Molecular Cloning, A Laboratory Manual, (Cold Spring Harbor Press, Cold Spring Harbor, N.Y.)(1989); Nucleic Acid Hybridization, A Practical Approach (Hames, B. D., and Higgins, S. J. eds, IRL Press, Oxford)(1985); WO 95/21944; Chalifour, et al., Anal. Biochem. (1994) 216: 299–304; Nguyen et al., Genomics (1995) 29: 207–216; Pietu et al., Genome Res. (1996) 6: 492–503; and Zhao et al., Gene (1995) 166: 207–213.

Use of non-isotopic labels in methods of differential gene expression analysis arc described in: Schena et al. Science (1995) 270: 467–470; Schena et al., Proc. Natl. Acad. Sci. USA (1996) 93: 10614–10619; DeRisi et al., Nature Genet. (1996) 14: 457–460; and Lockhart et al., Nature Biotechnol. (1996) 14: 1675–1680.

Methods of stably associating probes to the surface of substrates are described in: Hermanson, et al. Immobilized Affinity Ligand Techniques, Academic Press, (1992); WO 89/11548; European Patent No. 0 281 390 B1; WO 88/01302; European Patent Application No. 0392546; U.S. Pat. No. 5,436,327; U.S. Pat. No. 5,445,934.

Methods of improving hybridization of target to substrate surface associated probe are described in: EP 0 318 245 B1 (solution hybridization of probe to target followed by binding of hybridization complex to surface of substrate); Lockhart et al., Nature Biotechnol. (1996) 14: 1675–1680, EP 0 328 829 B1 (preamplification of target DNA/RNA); Maniatis et al., Molecular Cloning, A Laboratory Manual (Cold Spring Harbor Press, Cold Spring Harbor, N.Y., (1989), Nucleic Acid Hybridization, A Practical Approach (Hames, B. D., and Higgins, S. J. eds. IRL Press, Oxford) (1985), EP 0 229 442 (addition of an inert polymers such as dextran sulfate); U.S. Pat. No. 5,387,510, EP 0 318 245 B1 (use of "helper" oligonucleotides which reorder secondary and tertiary structure of target polynucleotide); WO 89/11548 (attaching probes to surface of substrate through long spacer arms).

Methods of improving specificity of hybridization are described in: U.S. Pat. Nos. 5,449,603 & 5,547,843 (use of single stranded nucleic acid binding protein); U.S. Pat. Nos. 4,888,274 & 5,223,414, EP 0 481 065 B1 (use of RecA protein-coated nucleoprotein target molecules); Khrapko et al., FEBS Lett. (1989) 256: 118–122 and U.S. Pat. No. 5,503,980 (continuous stacking interaction between short oligonucleotides of target and probe molecules, followed by enzymatic ligation step); and U.S. Pat. No. 5,434,047 (use of non-target probe which hybridized with non-target nucleic acid).

SUMMARY OF THE INVENTION

Methods and compositions for identifying differences between the nucleic acid profiles of a plurality of biological samples are provided. In the subject methods, a set of a representational number of different gene specific primers is used to generate labeled target nucleic acids from samples of nucleic acids, usually ribonucleic acids, derived from at least two different physiological sources. The labeled target nucleic acids derived from each physiological source are then compared, preferably by hybridization to arrays of probe nucleic acids stably associated with the surface of a substrate. The subject methods find use in differential gene expression analysis.

DESCRIPTION OF THE SPECIFIC EMBODIMENTS

Methods and compositions are provided for analyzing differences in the ribonucleic acid profiles between two or more physiological sources. In the subject methods, a set of a representational number of gene specific primers is used to generate labeled target nucleic acids from the physiological sources. The labeled target nucleic acids from each of the samples are then compared, preferably by hybridizing the labeled target nucleic acids from each sample to an array of probe nucleic acids stably associated with the surface of a substrate. Also provided are sets of gene specific primers employed in the subject methods, as well as kits comprising the sets of gene specific primers. The subject methods find use in a variety of applications, including differential gene expression assays.

Before the subject invention is further described, it is to be understood that the invention is not limited to the particular embodiments of the invention described below, as variations of the particular embodiments may be made and still fall within the scope of the appended claims. It is also to be understood that the terminology employed is for the purpose of describing particular embodiments, and is not intended to be limiting. Instead, the scope of the present invention will be established by the appended claims.

It must be noted that as used in this specification and the appended claims, the singular forms "a," "an," and "the" include plural reference unless the context clearly dictates otherwise. Unless defined otherwise all technical and scientific terms used herein have the same meaning as commonly understood to one of ordinary skill in the art to which this invention belongs.

Critical to the subject invention is the use of a set (i.e. pool, mixture, collection) of a representational number of gene specific primers to generate labeled nucleic acids from a sample of nucleic acids, usually ribonucleic acids (RNAs), where the labeled nucleic acids may act as "target" in subsequent hybridization assays, described in greater detail below. As used herein, the term nucleic acid is used in the broadest sense to refer to any sized multimer of nucleotide monomeric units, including short multimers such as dimers, trimers and the like, as well as longer multimers such as oligonucleotides and polynucleotides, where oligonucleotides generally denotes single stranded nucleotide multimers of from about 10 to 100 nucleotides and up to 200 nucleotides in length, and polynucleotides typically refers to single or double stranded nucleotide monomers of generally greater than 100 nucleotides in length.

As the subject sets comprise a representational number of primers, the total number of different primers in any given set will be only a fraction of the total number of different or distinct RNAs in the sample, where the total number of primers in the set will generally not exceed 80%, usually will not exceed 50% and more usually will not exceed 20% of the total number of distinct RNAs, usually the total number of distinct messenger RNAs (mRNAs), in the sample. Any two given RNAs in a sample will be considered distinct or different if they comprise a stretch of at least 100 nucleotides in length in which the sequence similarity is less then 98%, as determined using the FASTA program (default settings). As the sets of gene specific primers comprise only a representational number of primers, with physiological sources comprising from 5,000 to 50,000 distinct RNAs, the number of different gene specific primers in the set of gene specific primers will typically range from about 20 to 10,000, usually from 50 to 2,000 and more usually from 75 to 1500.

Each of the gene specific primers of the sets described above will be of sufficient length to specifically hybridize to a distinct nucleic acid member of the sample, e.g. RNA or cDNA, where the length of the gene specific primers will usually be at least 8 nt, more usually at least 20 nt and may be as long as 25 nt or longer, but will usually not exceed 50 nt. The gene specific primers will be sufficiently specific to hybridize to complementary template sequence during the generation of labeled nucleic acids under conditions sufficient for first strand cDNA synthesis, which conditions are known by those of skill in the art. The number of mismatches between the gene specific primer sequences and their complementary template sequences to which they hybridize during the generation of labeled nucleic acids in the subject methods will generally not exceed 20%, usually will not exceed 10% and more usually will not exceed 5%, as determined by FASTA (default settings).

Generally, the sets of gene specific primers will comprise primers that correspond to at least 20, usually at least 50 and more usually at least 75 distinct genes as represented by distinct mRNAs in the sample, where the term "distinct" when used to describe genes is as defined above, where any two genes are considered distinct if they comprise a stretch of at least 100 nt in their RNA coding regions in which the sequence similarity does not exceed 98%, as determined by FASTA (default settings).

The gene specific oligonucleotide primers may be synthesized by conventional oligonucleotide chemistry methods, where the nucleotide units may be: (a) solely nucleotides comprising the heterocyclic nitrogenous bases found in naturally occurring DNA and RNA, e.g. adenine, cytosine, guanine, thymine and uracil; (b) solely nucleotide analogs which are capable of base pairing under hybridization conditions in the course of DNA synthesis such that they function as the above nucleotides found in naturally occurring DNA and RNA, where illustrative nucleotide analogs include inosine, xanthine, hypoxanthine, 1,2-diaminopurine and the like; or (c) from combinations of the nucleotides of (a) and nucleotide analogs of (b), where with primers comprising a combination of nucleotides and analogues thereof, the number of nucleotide analogues in the primers will typically be less than 25 and more typically less than 5. The gene specific primers may comprise reporter or hapten groups, usually 1 to 2, which serve to improve hybridization properties and simplify detection procedure.

Depending on the particular point at which the gene specific primers are employed in the generation of the labeled nucleic acids, e.g. during first strand cDNA synthesis or following one or more distinct amplification steps, each gene specific primer may correspond to a particular RNA by being complementary or similar, where similar usually means identical, to the particular RNA. For example, where the gene specific primers are employed in the synthesis of first strand cDNA, the gene specific primers will be complementary to regions of the RNAs to which they correspond.

Each gene specific primer can be complementary to a sequence of nucleotides which is unique in the population of nucleic acids, e.g. mRNAs, with which the primers are contacted, or one or more of the gene specific primers in the set may be complementary to several nucleic acids in a given population, e.g. multiple mRNAs, such that the gene specific primer generates labeled nucleic acid when one or more of a set of related nucleic acid species, e.g. species having a conserved region to which the primer corresponds, are present in the sample. Examples of such related nucleic acid species include those comprising: repetitive sequences, such as Alu repeats, Al repeats and the like; homologous sequences in related members of a gene-family; polyadenylation signals; splicing signals; or arbitrary but conversed sequences.

The gene specific primers of the sets of primers according to the subject invention are typically chosen according to a number of different criteria. In some embodiments of the invention, primers of interest for inclusion in the set include primers corresponding to genes which are typically differentially expressed in different cell types, in disease states, in response to the influence of external agents, factors or infectious agents, and the like. In other embodiments, primers of interest are primers corresponding to genes which are expected to be, or already identified as being, differentially expressed in different cell, tissue or organism types. Preferably, at least 2 different gene functional classes will be represented in the sets of gene specific primers, where the number of different functional classes of genes represented in the primer sets will generally be at least 3, and will usually be at least 5. In other words, the sets of gene specific primers comprise nucleotide sequences complementary to RNA transcripts of at least 2 gene functional classes, usually at least 3 gene functional classes, and more usually at least 5 gene functional classes. Gene functional classes of interest include oncogenes; genes encoding tumor suppressors; genes encoding cell cycle regulators; stress response genes; genes encoding ion channel proteins; genes encoding transport proteins; genes encoding intracellular signal transduction modulator and effector factors; apoptosis related genes; DNA synthesis/recombination/repair genes; genes encoding transcription factors; genes encoding DNA-binding proteins; genes encoding receptors, including receptors for growth factors, chemokines, interleukins, interferons, hormones, neurotransmitters, cell surface antigens, cell adhesion molecules etc.; genes encoding cell-cell communication proteins, such as growth factors, cytokines, chemokines, interleukins, interferons, hormones etc.; and the like. Less preferred are gene specific primers that are subject to formation of strong secondary structures with less than −10 kcal/mol; comprise stretches of homopolymeric regions, usually more than 5 identical nucleotides; comprise more than 3 repetitive sequences; have high, e.g. more than 80%, or low, e.g. less than 30%, GC content etc.

The particular genes represented in the set of gene specific primers will necessarily depend on the nature of physiological source from which the RNAs to be analyzed are derived. For analysis of RNA profiles of eukaryotic physiological sources, the genes to which the gene specific primers correspond will usually be Class 11 genes which are transcribed into RNAs having 5' caps, e.g. 7-methyl guanosine or 2,2,7-trimethylguanosine, where Class II genes of particular interest are those transcribed into cytoplasmic mRNA comprising a 7-methyl guanosine 5' cap and a polyA tail.

For analysis of RNA profiles of mammalian physiological sources, of particular interest are gene specific primers corresponding to the functional gene classes listed above. For analysis of RNA profiles of human physiological sources, the gene specific primers of particular interest are the gene specific primers identified in Table 1 of application Ser. No. 08/859,008, now U.S. Pat. No. 5,961,834 filed May 21, 1997 (the disclosure of which is herein incorporated by reference) as SEQ ID NO:01 to SEQ ID NO:1372, where sets of these primers will usually include at least 20 and more usually at least 50 of these specific sequences. Also of interest are those gene specific primers corresponding to those genes (and specific capable of producing target capable of hybridizing to those specific regions of the genes) as listed in the following copending patent applications, the disclosures of which are herein incorporated by reference: U.S. application Ser. No. 09/221,480 entitled Apoptosis Array, now abandoned; U.S. application Ser. No. 09/222,432 entitled Cancer Array now abandoned; U.S. application Ser. No. 09/222,436 entitled Cell Cycle Array now abandoned; U.S. application Ser. No.09/222,437 entitled Cell Interaction Array now abandoned; U.S. application Ser. No. 09/222,251 entitled Cytokine Receptor Array now abandoned; U.S. application Ser. No. 09/221,481 entitled Human Array; U.S. application Ser. No. 09/222,256 entitled Human Stress Array; U.S. application Ser. No. 09/222,248 entitled Mouse Array now U.S. Pat. No. 6,077,673; and U.S. application Ser. No. 09/222,253 entitled Oncogene/Tumor Suppressor Array now abandoned.

Depending on the particular nature of the labeled nucleic acid generation step of the subject methods, the gene specific primers may be modified in a variety of ways. One way the gene specific primers may be modified is to include an anchor sequence of nucleotides, where the anchor is usually located 5' of the gene specific portion of the primer and ranges in length from 10 to 50 nt in length, usually 15 to 40 nt in length. The anchor sequence may comprise a sequence of bases which serves a variety of functions, such as a sequence of bases which correspond to the sequence found in promoters for bacteriophage RNA polymerase, e.g. T7 polymerase, T3 polymerase, SP6 polymerase, and the like; arbitrary sequences which can serve as subsequent primer binding sites; and the like.

Turning now to the methods employing the above sets of gene specific primers, the first step in the subject methods is to obtain a sample of nucleic acids, usually RNAs or nucleic acid derivatives thereof, from a physiological source, usually a plurality of physiological sources, where the term plurality is used to refer to 2 or more distinct physiological sources. The physiological source of RNAs will typically be eukaryotic, with physiological sources of interest including sources derived single celled organisms such as yeast and multicellular organisms, including plants and animals, particularly mammals, where the physiological sources from multicellular organisms may be derived from particular organs or tissues of the multicellular organism, or from isolated cells derived therefrom. Thus, the physiological sources may be different cells from different organisms of the same species, e.g. cells derived from different humans, or cells derived from the same human (or identical twins) such that the cells share a common genome, where such cells will usually be from different tissue types, including normal and diseased tissue types, e.g. neoplastic, cell types. In obtaining the sample of RNAs to be analyzed from the physiological source from which it is derived, the physiological source may be subjected to a number of different processing steps, where such processing steps might include tissue homogenation, nucleic acid extraction and the like, where such processing steps are known to the those of skill in the art. Methods of isolating RNA from cells, tissues, organs or whole organisms are known to those of skill in the art and are described in Maniatis et al., Molecular Cloning: A Laboratory Manual (Cold Spring Harbor Press)(1989).

The next step in the subject methods is the generation of labeled nucleic acids representative of the nucleic acid, usually RNA, profile of the physiological source. As mentioned above, a set or pool of gene specific primers is used to generate the labeled nucleic acids from the sample of RNAs, where the labeled nucleic acids generated in this step may serve as "target" in subsequent assays in which the differences in the RNA profiles of at least two sources are analyzed. Since the subject sets or pools of primers are employed, a sub-population of nucleic acids is generated from the initial source, where the sub-population corresponds to only a portion or fraction of the initial nucleic acid source. As used herein, the term "target" refers to single stranded RNA, single stranded DNA and double stranded DNA, where the target is generally greater than 50 nt in length.

The set of primers may be used either in first strand cDNA synthesis or following one or more amplification steps. Furthermore, the actual synthesis of the labeled nucleic acids may be at the same step during which the sets of gene specific primers are employed, or the synthesis of the labeled nucleic acids may be one more steps subsequent to the step in which the sets of gene specific primers are employed.

In a first embodiment of the invention, the set of gene specific primers is used to generate labeled first strand cDNA, where the labeled first strand cDNA is representative of the RNA profile of the physiological source being assayed. The labeled first strand cDNA is prepared by contacting the RNA sample with the primer set and requisite reagents under conditions sufficient for hybrid duplexes (i.e. double stranded primer complexes) to be produced followed by reverse transcription of the RNA template in the sample. Requisite reagents contacted with the primers and RNAs are known to those of skill in the art and will generally include at least an enzyme having reverse transcriptase activity and dNTPs in an appropriate buffer medium.

A variety of enzymes, usually DNA polymerases, possessing reverse transcriptase activity can be used for the first strand cDNA synthesis step. Examples of suitable DNA polymerases include the DNA polymerases derived from organisms selected from the group consisting of a thermophilic bacteria and archaebacteria, retroviruses, yeasts, Neurosporas, Drosophilas, primates and rodents. Preferably, the DNA polymerase will be selected from the group consisting of Moloney murine leukemia virus (M-MLV) as described in U.S. Pat. No. 4,943,531 and M-MLV reverse transciptase lacking RNaseH activity as described in U.S. Pat. No. 5,405,776 (the disclosures of which patents are herein incorporated by reference), human T-cell leukemia virus type I (HTLV-I), bovine leukemia virus (BLV), Rous sarcoma virus (RSV), human immunodeficiency virus (HIV) and Thermus aquaticus (Taq) or Thermus thermophilus (Tth) as described in U.S. Pat. No. 5,322,770, the disclosure of which is herein incorporated by reference. Suitable DNA polymerases possessing reverse transcriptase activity may be isolated from an organism, obtained commercially or obtained from cells which express high levels of cloned genes encoding the polymerases by methods known to those of skill in the art, where the particular manner of obtaining the polymerase will be chosen based primarily on factors such as convenience, cost, availability and the like.

The various dNTPs and buffer medium necessary for first strand cDNA synthesis through reverse transcription of the primed RNAs may be purchased commercially from various sources, where such sources include Clontech, Sigma, Life Technologies, Amersham, Boehringer-Mannheim. Buffer mediums suitable for first strand synthesis will usually comprise buffering agents, usually in a concentration ranging from 10 to 100 $\mu$M which typically support a pH in the range 6 to 9, such as Tris-HCl, HEPES-KOH, etc.; salts containing monovalent ions, such as KCl, NaCl, etc., at concentrations ranging from 0–200 mM; salts containing divalent cations like $MgCl_2$, Mg(OAc) etc, at concentrations usually ranging from 1 to 10 mM; and additional reagents such as reducing agents, e.g. DDT, detergents, albumin and the like. The conditions of the reagent mixture will be selected to promote efficient first strand synthesis. Typically the set of primers will first be combined with the RNA sample at an elevated temperature, usually ranging from 50 to 95° C., followed by a reduction in temperature to a range between about 0 to 60° C., to ensure specific annealing of the primers to their corresponding RNAs in the sample. Following this annealing step, the primed RNAs are then combined with dNTPs and reverse transcriptase under conditions sufficient to promote reverse transcription and first strand cDNA synthesis of the primed RNAs. By using appropriate types of reagents, all of the reagents can be combined at once if the activity of the polymerase can be postponed or timed to start after annealing of the primer to the RNA.

In this embodiment, one of either the gene specific primers or dNTPs, preferably the dNTPs, will be labeled such that the synthesized cDNAs are labeled. By labeled is meant that the entities comprise a member of a signal producing system and are thus detectable, either directly or through combined action with one or more additional members of a signal producing system. Examples of directly detectable labels include isotopic and fluorescent moieties incorporated into, usually covalently bonded to, a nucleotide monomeric unit, e.g. dNTP or monomeric unit of the primer. Isotopic moieties or labels of interest include $^{32}P$, $^{33}P$, $^{35}S$, $^{125}I$, and the like. Fluorescent moieties or labels of interest include coumarin and its derivatives, e.g. 7-amino-4-methylcoumarin, aminocoumarin, bodipy dyes, such as Bodipy FL, cascade blue, fluorescein and its derivatives, e.g. fluorescein isothiocyanate, Oregon green, rhodamine dyes, e.g. texas red, tetramethylrhodamine, eosins and erythrosins, cyanine dyes, e.g. Cy3 and Cy5, macrocyclic chelates of lanthanide ions, e.g. quantum dye™, fluorescent energy transfer dyes, such as thiazole orange-ethidium heterodimer, TOTAB, etc. Labels may also be members of a signal producing system that act in concert with one or more additional members of the same system to provide a detectable signal. Illustrative of such labels are members of a specific binding pair, such as ligands, e.g. biotin, fluorescein, digoxigenin, antigen, polyvalent cations, chelator groups and the like, where the members specifically bind to additional members of the signal producing system, where the additional members provide a detectable signal either directly or indirectly, e.g. antibody conjugated to a fluorescent moiety or an enzymatic moiety capable of converting a substrate to a chromogenic product, e.g. alkaline phosphatase conjugate antibody; and the like. For each sample of RNA, one can generate labeled oligos with the same labels. Alternatively, one can use different labels for each physiological source, which provides for additional assay configuration possibilities, as described in greater detail below.

In a variation of the above embodiment, where desired one can generate labeled RNA instead of labeled first strand cDNA. In this embodiment, first strand cDNA synthesis is carried out in the presence of unlabeled dNTPs and unlabeled gene specific primers. However, the primers are optionally modified to comprise a promotor for an RNA polymerase, such as T7 RNA polymerase, T3 RNA polymerase, SP6 RNA polymerase, and the like. In this embodiment, following first strand cDNA synthesis, the resultant single stranded cDNA is then converted to double stranded cDNA, where the resultant double stranded cDNA comprises the anchor sequence comprising the promoter region. Conversion of the mRNA:cDNA hybrid following first strand synthesis can be carried out as described in Okayama & Berg, Mol. Cell. Biol. (1982) 2:161–170, and Gubler & Hoffman, Gene (1983) 25: 253–269, where briefly the RNA is digested with a ribonuclease, such as *E.coli* RNase H, followed by repair synthesis using a DNA polymerase like DNA polymerase I, etc., and *E.coli* DNA ligase. One may also employ the modification of this basic method described in Wu, R, ed., Methods in Enzymology (1987), vol. 153 (Academic Press). Next, the double stranded cDNA is contacted with RNA polymerase and dNTPs, including labeled dNTPs, to produce linearly amplified labeled ribonucleic acids. For cDNA lacking the anchor sequence comprising a promoter region, a polymerase that does not need a promoter region but instead can initiate RNA strand synthesis randomly from cDNA, such as core fragment of *E. Coli* RNA polymerase, may be employed.

In another embodiment of the subject invention, the labeled nucleic acid generation step comprises one or more enzymatic amplification steps in which multiple DNA copies of the initial RNAs present in the sample are produced, from which multiple copies of the initial RNA or multiple copies of antisense RNA (aRNA) may be produced, using the polymerase chain reaction, as described in U.S. Pat. No. 4,683,195, the disclosure of which is herein incorporated by reference, in which repeated cycles of double stranded DNA denaturation, oligonucleotide primer annealing and DNA polymerase primer extension are performed, where the PCR conditions may be modified as described in U.S. Pat No. 5,436,149, the disclosure of which is herein incorporated by reference.

In one embodiment involving enzymatic amplification, the set of gene-specific primers are employed in the generation of the first strand cDNA, followed by amplification of the first strand cDNA to produce amplified numbers of labeled cDNA. In this embodiment, as a set of gene-specific primers is employed in the first strand synthesis step, only a representative proportion of the total RNA in the sample is amplified during the subsequent amplification steps.

Amplification of the first strand cDNA can be conveniently achieved by using a CAPswitch™ oligonucleotide as described in U.S. patent application Ser. No. 08/582,562, the disclosure of which is herein incorporated by reference. Briefly, the CAPswitch™ technology uses a unique CAPswitch™ oligonucleotide in the first strand cDNA synthesis followed by PCR amplification in the second step to generate a high yield of ds cDNA. When included in the first-strand cDNA synthesis reaction mixture, the CAPswitch™ oligonucleotide serves as a short extended template. When reverse transcriptase stops at the 5' end of the mRNA template in the course of first strand cDNA synthesis it switches templates and continues DNA synthesis to the end of the CAPswitch™ oligonucleotide. The resulting ss cDNA incorporates at the 3' end, sequence which is complimentary to complete 5' end of the mRNA and the CAPswitch™ oligonucleotide sequence.

Of particular interest as the CAPswitch™ oligonucleotide are oligonucleotides having the following formula:

5'-dN1-dN2- . . . dNm-rN1-rN2 . . . rNn-3' wherein:
dN represents a deoxyribonucleotide selected from among dAMP, dCMP, dGMP and dTMP;

m represents an integer 0 and above, preferably from 10 to 50;

rN represents a ribonucleotide selected from the group consisting of AMP, CMP, GMP and UMP, preferably GMP; and n represents an integer 0 and above, preferably from 3 to 7.

The structure of the CAPswitch™ oligonucleotide may be modified in a number of ways, such as by replacement of 1 to 10 nucleotides with nucleotide analogs, incorporation of terminator nucleotides, such as 3'-amino NMP, 3'-phosphate NMP and the like, or non-natural nucleotides which can improve efficiency of the template switching reaction but still retain the main function of the CAPswitch™ oligonucleotide i.e. CAP-depended extension of full-length cDNA by reverse transcriptase using CAPswitch™ oligonucleotide as a template.

In using the CAPswitch™ oligonucleotide, first strand cDNA synthesis is carried out in the presence of a set of gene specific primers and a CAPswitch™ oligonucleotide, where the gene specific primers have been modified to comprise an arbitrary anchor sequence at their 5' ends. The first strand cDNA is then combined with primer sequences complementary to: (a) all or a portion of the CAPswitch™ oligonucleotide and (b) the arbitrary anchor sequence of the gene specific primers and additional PCR reagents, such as dNTPs, DNA polymerase, and the like, under conditions sufficient to amplify the first strand cDNA. Conveniently, PCR is carried out in the presence of labeled dNTPs such that the resultant, amplified cDNA is labeled and serves as the labeled or target nucleic acid. Labeled nucleic acid can also be produced by carrying out PCR in the presence of labeled primers, where either or both the CAPswitch™ oligonucleotide complementary primer and anchor sequence complementary primer may be labeled. In yet an alternative embodiment, instead of producing labeled amplified cDNA, one may generate labeled RNA from the amplified ds cDNA, e.g. by using an RNA polymerase such as *E. coli* RNA polymerase, or other RNA polymerases requiring promoter sequences, where such sequences may be incorporated into the arbitrary anchor sequence.

Instead of using the set of gene specific primers in the first strand cDNA synthesis step followed by subsequent amplification of only a representative fraction of the total number of distinct RNA species in the sample, one may also amplify all of the RNAs in the sample and use the set of gene specific primers to generate labeled nucleic acid following amplification. This embodiment may find use in situations where the RNA of interest to be amplified is known or postulated to be in small amounts in the sample.

In this embodiment, first strand synthesis is carried out using: (a) an oligo dT primer that usually comprises an arbitrary anchor sequence at its 5' end and (b) a CAPswitch™ oligonucleotide. During first strand synthesis the oligo(dT) anneals to the polyA tail of the mRNA in the sample and synthesis extends beyond the 3' end of the RNA to include the CAPswitch™ oligonucleotide, yielding a first strand cDNA comprising an arbitrary sequence at its 5' end and a region complementary to the CAPswitch™ oligonucleotide at its 3' end. The length of the dT primer will typically range from 15 to 30 nts, while the arbitrary anchor sequence or portion of the primer will typically range from 15 to 25 nt in length.

Following first strand synthesis, the cDNA is amplified by combining the first strand cDNA with primers that correspond at least partially to the anchor sequence and the CAPswitch™ oligonucleotide under conditions sufficient to produce an amplified amount of the cDNA. Labeled nucleic acid is then produced by contacting the resultant amplified cDNA with a set of gene specific primers, a polymerase and dNTPs, where at least one of the gene specific primers and dNTPs are labeled.

The labeled nucleic acids produced above provide a representation of the total RNA profile of the particular source from which the labeled nucleic acids are generated. Accordingly, the labeled nucleic acids find use in comparing the characteristic RNA profiles of different physiological sources and identifying differences in the RNA profiles between different physiological source. Comparison of the RNA profiles of two or more physiological sources finds particular use in methods of identifying differential gene expression in two physiological samples, such as cells or tissues derived from the same or different individual organisms, where the tissues may represent different diseased or normal states, different organ or tissue types, etc.

The labeled nucleic acids of the plurality of physiological sources may be compared in a number of different ways. Thus, one may compare the labeled nucleic acids from each source by separately resolving the labeled nucleic acids from each source under substantially identical electrophoretic conditions to yield an electrophoretic pattern of resolved bands for each of the different populations of labeled nucleic acids. The resultant electrophoretic patterns can then be resolved to identify differences between the labeled nucleic acid populations, which differences can then be attributed to differences in the RNA profiles of the each of the physiological sources, where such differences can, in turn, be attributed to difference in gene expression. See Liang & Pardee, Science (1992) 257: 967. Conveniently, electrophoretic separation under identical electrophoretic conditions can be achieved by running the labeled nucleic acids derived from each physiological source of interest in separate, side by side lanes on a slab gel. Automated electrophoretic machines as described in U.S. Pat. Nos. 5,410,412; 5,275,710; 5,217,591; and 5,104,512, the disclosures of which are herein incorporated by references, may be employed to resolve the labeled nucleic acids. In a modification of the above, where each set of labeled nucleic acids or targets of each physiological source has been labeled with a distinct and distinguishable label, the opportunity arises to resolve the nucleic acids in the same electrophoretic medium, e.g. the same column or in the same lane of a slab, thereby ensuring that the nucleic acids are resolved under identical electrophoretic conditions.

Alternatively, one may hybridize the labeled nucleic acids to predefined arrays of probe polymeric molecules stably associated with the surface of a substrate, where the probe polymeric molecules are capable of sequence specific base pair hybridization with complementary labeled target nucleic acids. A variety of different arrays which may be used are known in the art. The polymeric or probe molecules of the arrays may be oligonucleotides or hybridizing analogues or mimetics thereof, including: nucleic acids in which the phosphodiester linkage has been replaced with a substitute linkage, such as phophorothioate, methylimino, methylphosphonate, phosphoramidate, guanidine and the like; nucleic acids in which the ribose subunit has been substituted, e.g. hexose phosphodiester; peptide nucleic acids; and the like. The length of the probes will generally range from 10 to 1000 nts, where oligonucleotide probes usually range from 15 to 150 nts and more usually from 15 to 100 nts in length, and polynucleotide probes usually range in length from 150 to 1000 nts, where the polynucleotide probes may be single or double stranded, usually single stranded, and may be PCR fragments amplified from cDNA.

The probe molecules on the surface of the substrates will preferably correspond to known genes of the physiological source being analyzed so that positive hybridization events may be correlated to expression of a particular gene in the physiological source. Of particular interest are arrays of probes which correspond to a particular subset of the total genes expressed by a particular physiological source. For example, for analysis of human physiological sources, preferably the arrays of probes will correspond to a particular subset of all the expressed human genes, such as those genes associated with cell-cell communication, cancer related genes, etc. The arrays of probes may have sequences that are complementary to the template and/or non-template strands of the gene to which they correspond, depending on the nature of the labeled target nucleic acid to which they are to hybridize.

The substrates with which the probe molecules are stably associated may be fabricated from a variety of materials, including plastics, ceramics, metals, gels, membranes, glasses, and the like.

A variety of different methodologies have been developed for producing arrays of probes stably associated to the surface of a substrate. Representative methodologies include spotting methods, in which probes are immobilized or spotted on the surface of substrates as described in WO 95/35505 the disclosure of which is herein incorporated by reference, and methods in which the probes are synthesized or grown on the surface of the substrates, such as EP 0 373 203 B1 and U.S. Pat. No. 5,445,934, the disclosures of which are herein incorporated by reference. Arrays of probes spotted onto nylon membranes are described in Lennon & Lerach, Trends in Genetics (1991) 7:314–317; Gress et al., Mammalian Genome (1992) 3:609–619; Meier-Ewert et al., Nature (1993) 361:375–376; Nguyen et al., Genomics (1995) 29:207–216; Zhao et al., Gene (1995) 156:207–213; Takahashi et al., Gene (1995) 164:219–217; Milosavlijevic et al., Genome Research (1996) 6:132–141; Pietu et al., Genome Research (1996) 6:492–503; and Drmanac, Science (1993) 260:1649–1652. Arrays of probes spotted onto the surface of modified microscope glass slides are described in Shena et al., Science (1995) 270: 467–470 and Shalon et al., Genome Research (1996) 6: 639–645. Arrays in which the probes have been grown on the surface of a substrate are described in Lockhart et al., Nature Biotechnology (1996) 14:1675.

Of particular interest for use in the analysis of differential gene expression in human physiological sources are the arrays of subsets human cDNAs sold under the trademark Atlas™ by Clontech and described in CLONTECHniques (April, 1997) 12:4–7.

In analyzing the differences in the population of labeled nucleic acids generated from two or more physiological sources using the arrays described above, each population of labeled nucleic acids are separately contacted to identical probe arrays under conditions of hybridization, preferably under stringent hybridization conditions, such that labeled nucleic acids hybridize to their complementary probes on the substrate surface. Suitable hybridization conditions are well known to those of skill in the art and reviewed in Maniatis et al, supra and WO 95/21944.

As with the electrophoretic analysis, where all of the target sequences comprise the same label, different arrays will be employed for each physiological source (where different could include using the same array at different times). Alternatively, where the labels of the targets are different and distinguishable for each of the different physiological sources being assayed, the opportunity arises to use the same array at the same time for each of the different target populations.

In one preferred embodiment of assays using arrays, the number of gene specific primers used to generate the target will be chosen in view of the number of distinct probes present on the surface of the substrate of the array. In such instances, the number of gene specific primers in the set will not vary by more than 10 fold from the number of distinct probes, usually by not more than 5 fold and more usually by not more than 2 fold from the number of distinct probes in the array.

Following hybridization, non-hybridized labeled nucleic acid is removed from the support surface, conveniently by washing, generating a pattern of hybridized nucleic acid on the substrate surface. A variety of wash solutions are known to those of skill in the art and may be used.

The resultant hybridization patterns of labeled nucleic acids may be visualized or detected in a variety of ways, with the particular manner of detection being chosen based on the particular label of the nucleic acid, where representative detection means include scintillation counting, autoradiography, fluorescence measurement, calorimetric measurement, light emission measurement and the like.

Following detection or visualization, the hybridization patterns may be compared to identify differences between the patterns. Where arrays in which each of the different probes corresponds to a known gene are employed, any discrepancies can be related to a differential expression of a particular gene in the physiological sources being compared.

The subject methods find use in, among other applications, differential gene expression assays. Thus, one may use the subject methods in the differential expression analysis of: (a) diseased and normal tissue, e.g. neoplastic and normal tissue, (b) different tissue or subtissue types; and the like.

Also provided are kits for use in carrying out the subject methods, e.g. generating populations of labeled nucleic acids, performing differential gene expression analysis and the like. The kits according to the subject invention include at least the set of gene specific primers that are employed to generate the labeled oligonucleotides. Of particular interest are kits comprising a set of primers selected from the primers identified as SEQ ID NO: 01–1372 in application Ser. No. 08/859,008 filed May 21, 1997, the disclosure of which is herein incorporated by reference, where in these kits of particular interest, at least twenty, usually at least 50 and more usually at least 100 of the gene specific primers in the kit will be selected from this group of primers identified as SEQ ID NO: 01–1372. Also of interest are kits comprising those gene specific primers corresponding to those genes (and specific capable of producing target capable of hybridizing to those specific regions of the genes) as listed in the following copending patent applications, the disclosures of which are herein incorporated by reference: U.S. application Ser. No. 09/221,480 entitled Apoptosis Array now abandoned; U.S. application Ser. No. 09/222,432 entitled Cancer Array now abandoned; U.S. application Ser. No. 09/222,437 entitled Cell Cycle Array now abandoned; U.S. application Ser. No. 09/222,437 entitled Cell Interaction Array; U.S. application now abandoned Ser. No. 09/222,251 entitled Cytokine Receptor Array now abandoned; U.S. application Ser. No. 09/221,481 entitled Human Array; U.S. application Ser. No. 09/222,256 entitled Human Stress Array; U.S. application Ser. No. 09/222,248 entitled Mouse Array now U.S. Pat. No. 6,077,673; and U.S. application Ser. No. 09/222,253 entitled Oncogene/Tumor Suppressor Array now abandoned. The kits may further comprise one or more additional reagents employed in the various methods, such as additional non-gene specific primers sequences, such as SEQ ID NO: 1373 to 1375 of application Ser. No. 08/859, 008 filed May 21, 1997, the disclosure of which is herein incorporated by reference, dNTPs and/or rNTPs, which may be either premixed or separate, one or more uniquely labeled dNTPs and/or rNTPs, such as biotinylated or Cy3 or Cy5 tagged dNTPs, enzymes, such as reverse transcriptases, DNA polymerases, and the like, various buffer mediums, e.g. hybridization and washing buffers, prefabricated probe arrays, labeled probe purification reagents and components, like spin columns, etc., signal generation and detection reagents, e.g. streptavidin-alkaline phosphatase conjugate, chemifluorescent or chemiluminescent substrate, and the like.

The following examples are offered by way of illustration and not by way of limitation. Except where noted otherwise, all percentages are by weight and all solvent mixture proportions are by volume.

EXPERIMENTAL

Example 1

Generation of $^{32}$P-labeled Oligonucleotides During First Strand cDNA Synthesis Step A. cDNA Synthesis/Labeling Procedure 1 µg of polyA+RNA was converted into $^{32}$P-labeled first-strand cDNA as follows. A sufficient volume of master mix for all labeling reactions and 1 extra reaction was prepared as follows to ensure sufficient volume. For each 10-µl labeling reaction, the following reagents were mixed:

| | |
|---|---|
| 2 µl | 5X First-strand buffer (250 µM Tris-HCl pH 8.3; 375 mM KCl; 15 mM MgCl$_2$) |
| 1 µl | 10XdNTP mix (500 µM dGTP, 500 µM dCTP, 500 µM dTTP, 5 µM dATP) |
| 4 µl | [α-$^{32}$P]dATP (Amersham, 3000 Ci/mmol, 10 mCi/ml) |
| 1 µl | MMLV reverse transcriptase (Amersham, 200 units/µl) |
| 8 µl | Final volume |

Next, the following reagents were combined in a 0.5-ml PCR test tube:

| | |
|---|---|
| 1 µg (1–2 µl) | polyA + RNA sample |
| 1 µl | 10x gene-specific primers mix (0.2 µM of each oligonucleotide ID No. 2, 4, 6, 8, 10, 12, . . ., 1372 as listed in application Serial No. 08/859,008 filed May 21, 1997, the disclosure of which is herein incorporated by reference) |

As a control, in separate test tube were mixed 1 µg of polyA+RNA sample with 1 µl of oligo dT primer (CDS1, ID No. 1373 as listed in application Ser. No. 08/859,008 filed May 21, 1997, the disclosure of which is herein incorporated by reference).

For each tube ddH$_2$O was added to a final volume of 3 ul and the contents were mixed and spun briefly in a microcentrifuge. The tubes were then incubated in a preheated PCR thermocycler at 70° C. for 2 min. The temperature in thermocycle was reduced down to 50° C. and the tube contents were incubated for 2 min. 8 µl of master mix as prepared above were added to each reaction test tube. The contents of the test tubes were then mixed by gentle pipetting. The tubes were then incubated in a PCR thermocycler for 20 min at 50° C. The reaction was then stopped by adding 1 μl of 10× termination mix (0.1 M EDTA, 1 mg/ml glycogen).

Step B. Column Chromatography

The $^{32}$P-labeled cDNAs were separated from unincorporated $^{32}$P-labeled nucleotides and small (<0.1-kb) cDNA fragments using the following procedure for each test tube. A CHROMA SPIN-200 column (CLONTECH, Palo Alto, Calif.) was placed into a 1.5-ml microcentrifuge tube, the water was allowed to drain through the column by gravity flow until the surface of the gel beads emerged in the column matrix. The sample was then applied to the center of the gel bed's flat surface and allowed to be fully absorbed into the resin bed. 25 μl of ddH$_2$O were then applied and allowed to completely drain out of the column. 200 μl of ddH$_2$O were then applied and allowed to completely drain out of the column until there was no liquid left above the resin bed. The column was then transferred to a clean 1.5-ml microcentrifuge tube.

To collect the first fraction, 100 μl of ddH$_2$O were added to the column and allowed to completely drain out of the column. The second, third and fourth fractions were collected in analogous fashion. The tubes with fractions 1–4 were then placed in scintillation counter empty vials, and Cerenkov counts for each fraction were obtained in the tritium channel. The fractions which showed the highest Cerenkov counts were pooled.

Example 2

Generation of Cy3-labeled Hybridization Polynucleotide Target from Total RNA Using Preamplification Step CAPswitch™ technology can be effectively used for construction cDNA libraries using as a template 10–100 ng of total RNA. Any conventional procedure well known in art can be used to purify this small amount of total RNA from 10–50 mg of "difficult" cells or tissues, like human biopsy tissues, pathogenic microorganisms, tissues at different developmental stages etc.

Step A. First-Strand Synthesis—Template Switching 10 pmol of cDNA synthesis primer (oligo dT primer) CDS1 (ID No. 1373): 5'-d(TCTAGAATTCAGCGGCCGC(T)30VN)-3'

(where V=G or A or C; N=G or A or T or C)
and 10 pmol of CAPswitch™ oligonucleotide (CSO1):
CSO1 (ID No. 1374): 5'-d(CTAATACGACTCACTATAGGGC)r(GGG)-3'
were annealed to 100 ng of human skeletal muscle Total RNA (CLONTECH), in a volume of 5 ml of deionized water, by heating the mixture for 2 min at 70° C., followed by cooling on ice for 2 min. First-strand cDNA synthesis was then initiated by mixing the annealed primer-RNA with 200 units of M-MLV reverse transcriptase (Amersham) in a final volume of 10 μl, containing 50 mM Tris-HCl (pH 8.3 at 22° C.), 75 mM KCl, 6 mM MgCl2, 1 mM DTT, 1 mM of each dATP, dGTP, dCTP and dTTP. The first-strand cDNA synthesis-template switching reaction was incubated at 42° C. for 1.5 hr in an air incubator and then cooled on ice.

Step B. Generation of Full-length cDNA by PCR

PCR amplification of full-length cDNA was performed using the Advantage KlenTaq Polymerase Mix (CLONTECH). Amplification was conducted in a 200-μl volume containing 2 μl of first-strand cDNA, 40 mM Tricine-KOH (pH 9.2 at 22OC), 3.5 mM Mg(OAc)$_2$, 10 mM KOAc, 75 μg/ml BSA, 200 μM of each dATP, dGTP, dCTP and dTTP, 0.2 μM of each CAPswitch™ primer (CSP1, ID No. 1375 as identified in application Ser. No. 08/859,008 filed May 21, 1997, the disclosure of which is herein incorporated by reference) and CDS1 primer and 2 μl of KlenTaq Polymerase mix. Temperature parameters of the PCR reactions were as follows: 1 min at 95° C. followed by 20–22 cycles of 95° C. for 15 sec and 68° C. for 5 min, followed by a 10-min final extension at 68° C. PCR products were examined on 1.2% agarose/EtBr gels in 1× TBE buffer. As a DNA size marker, a 1 Kb DNA ladder was used. ds cDNA was then precipitated by addition of a half volume of 4M ammonium acetate (about 35 ml) and 3.7 volumes of 95% ethanol (about 260 ml). After vortexing, the tube was immediately centrifuged at 14,000 r.p.m. in a microcentrifuge for 20 min. The pellet was washed with 80% ethanol without vortexing, centrifuged as above for 10 min, air dried, and dissolved in 10 μl of deionized water. Yield of ds cDNA after amplification step is about 5 μg.

Step C. Labeling of cDNA by Cy3-dCTP.

5 μl of ds cDNA (2.5 μg) generated after amplification step were mixed with 4 μl of a mixture of 686 antisense gene-specific primers (0.1 μM each; ID No. 2,4,6,8,10, 12, . . . 1372 as listed in application Ser. No. 08/859,008 filed May 21, 1997, the disclosure of which is herein incorporated by reference) in a 0.5-ml PCR test tube, boiled at 100° C. for 5 min and quickly cooled in the ice. To the denatured DNA/gene-specific primer mix was added 5 μl of 5× reaction buffer (250 mM Tris-HCl, pH 7.5, 50 mM MgCl$_2$, 5 mM DTT, 250 μg/ml BSA), 10 μl 2.5×dNTP mix (500 μM each of dATP, dGTP and dTTP, 350 μM dCTP and 150 μM Cy3-dCTP (Amersham)), 0.5 μl of [α-$^{32}$P]dCTP (Amersham, 3000 Ci/mmol, 10 mCi/ml) and 0.5 μl of Advantage KlenTaq mix (Clontech). The mixture was incubated at 68° C. for 10 min and the reaction stopped by adding 1 μl of 10× termination mix (0.1 M EDTA, 1 mg/ml glycogen).

Step D. Column Chromatography

To purify the Cy3-labeled cDNAs from unincorporated Cy3-labeled nucleotides and small (<0.1-kb) cDNA fragments, a CHROMA SPIN-200 column (CLONTECH) was placed into a 1.5-ml microcentrifuge tube, water was drained from the column and the sample was applied to the center of the gel bed's flat surface and allowed to be fully absorbed into the resin bed. 25 μl of ddH$_2$O were applied and allowed to completely drain out of the column. 200 μl of ddH$_2$O were applied and the buffer was allowed to completely drain out of the column until there was no liquid left above the resin bed. The column was then transferred to a clean 1.5-ml microcentrifuge tube.

To collect the first fraction, 100 μl of ddH$_2$O was added to the column and allowed to completely drain out of the column. The second, third and fourth fractions were collected in analogous fashion. The tubes with fractions 1–4 were placed in scintillation counter empty vials, and Cerenkov counts were obtained for each fraction in the tritium channel. The fractions (usually fractions 2–3) which showed the highest Cerenkov counts were pooled, and other fractions were discarded.

Example 3

Generation of cDNA Array Probe Immobilized on Nylon Membrane 686 cDNA fragments corresponding 686 different human genes were amplified from quick-clone cDNA (CLONTECH) in 686 separate test tubes using a combination of sense and antisense gene-specific primers: SEQ ID Nos. 1+2, 3+4, 5+6, 7+8, . . . 1371+1372 as listed in application Ser. No. 08/859,008 filed May 21, 1997, the disclosure of which is herein incorporated by reference. Amplification was conducted in a 100-µl volume containing 2 µl of mixture of 10 Quick-clone cDNA from placenta, brain, liver, lung, leukocytes, spleen, skeletal muscle, testis, kidney and ovary (CLONTECH), 40 mM Tricine-KOH (pH 9.2 at 22° C.), 3.5 mM Mg(OAc)$_2$, 10 mM KOAc, 75 µg/ml BSA, 200 µM of each dATP, dGTP, dCTP and dTTP, 0.2 µM of each sense and antisense gene-specific primers and 2 µl of KlenTaq Polymerase mix. Temperature parameters of the PCR reactions were as follows: 1 min at 95° C. followed by 20–35 cycles of 95° C. for 15 sec and 68° C. for 2 min; followed by a 10-min final extension at 68° C. PCR products were examined on 1.2% agarose/EtBr gels in 1×TBE buffer. As a DNA size marker we used a 1 Kb DNA Ladder. ds cDNA was then precipitated by addition of a half volume of 4M ammonium acetate (about 35 ul) and 3.7 volumes of 95% ethanol (about 260 ul). After vortexing, the tube was immediately centrifuged at 14,000 r.p.m. in a microcentrifuge for 20 min. The pellet was washed with 80% ethanol without vortexing, centrifuged as above for 10 min, air dried, and dissolved in 10 µl of deionized water. Yield of ds cDNA after amplification step was about 5 µg. The ds cDNA was denatured by adding 1 µl of 10× denaturing solution (1 M NaOH, 10 mM EDTA) and incubating at 65° C. for 20 min. All cDNA probes were transferred in 384-well plate and loaded on positively charged nylon membrane (Schleher & Schull) using 384 pin tool and Biomek 2000 (Beckman) robot.

Example 4

Hybridization $^{32}$P-labeled cDNA Target with cDNA ARRAY

A solution of ExpressHyb™ (CLONTECH) and sheared salmon testes DNA (Sigma) was prepared by prewarming 15 ml of ExpressHyb™ at 50–60° C., heating 1.5 mg of sheared salmon testes DNA at 95–100° C. for 5 min followed by chilling quickly on ice, and combining the resultant heat-denatured sheared salmon testes DNA with the prewarmed ExpressHyb™.

A cDNA ARRAY (Atlas™Human cDNA Expression Array, Clontech, Palo Alto, Calif.) was then placed in a hybridization bottle and 10 ml of the solution prepared above was added to the bottle. Prehybridization was performed for 30 min with continuous agitation at 72° C. Labeled cDNA probe (Example 1, about 200 ul, total about 2–5×10$^6$ cpm) with 1/10th of the total volume (about 22 ul) of 10× denaturing solution (1 M NaOH, 10 mM EDTA) was mixed and incubated at 65° C. for 20 min. 5 µl (1 µg/ul) of human Cot-1 DNA was then added, and an equal volume (about 225 µl) of 2×Neutralizing solution (1M NaHPO4, pH 7.0) was added and incubation continued at 65° C. for 10 min. The mixtures were then combined and thoroughly mixed.

The prehybridization solution was then replaced with the solution comprising the labeled oligonucleotide as prepared above and allowed to hybridize overnight with continuous agitation at 65° C. Following hybridization, the hybridization solution was carefully removed and discarded, replaced with 200 ml of Wash Solution 1 (2×SSC, 1% SDS). The ARRAY was washed for 20 min with continuous agitation at 65° C. Washing was repeated four times.

Two additional 20-min washes were then performed in 200 ml of prewarmed Wash Solution 2 (0.1×SSC, 0.5% SDS) with continuous agitation at 65° C. Using forceps, cDNA ARRAY was removed from the container and excess wash solution was removed by shaking.

The damp membrane was immediately wrapped in plastic wrap, mounted on Whatman paper (3 mm Chr). Exposed to x-ray film at −70° C. with an intensifying screen.

Example 5

Comparison Between Using Sets of Gene Specific Primers and Oligo dT

FIG. 1 of application Ser. No. 08/859,008 filed May 21, 1997 (the disclosure of which is herein incorporated by reference) illustrates the effectiveness of using $^{32}$P-labelled polynucleotide target generated using sets of gene specific primers according to the subject invention in hybridization with a cDNA array of 588 probes immobilized on a nylon membrane.

$^{32}$P-labeled cDNA target were synthesized by M-MLV reverse transcriptase from a mixture 588 antisense gene-specific primers (B) or oligo dT(A) using placenta polyA+ RNA as a template as described in Example 1. Primer extension products generated by reverse transcription were purified by gel filtration as described in Example 1 and hybridized separately with two cDNA arrays comprising 588 human genes under identical conditions as described in Example 4. The arrows in pattern B indicate the position of signals which can be detected by using cDNA target generated using the set of gene specific primers but can not be detected by using conventional target generated with oligo dT primers (pattern A). The level of non-specific background detected as signal generated by membrane alone outside of the regions with immobilized probes generated by target generated using oligo dT primers was significantly higher (filter A) in comparison with the background generated by the target generated by using the sets of gene specific primers (filter B).

It is evident from the above results and discussion that the subject invention provides for improved methods of assaying for differential expression. With the subject methods, specificity and efficiency are improved, as compared to previous methods of differential gene expression analysis in which sets of gene specific primers are not employed to generate labeled nucleic acids.

All publications and patent applications cited in this specification are herein incorporated by reference as if each individual publication or patent application were specifically and individually indicated to be incorporated by reference. The citation of any publication is for its disclosure prior to the filing date and should not be construed as an admission that the present invention is not entitled to antedate such publication by virtue of prior invention.

Although the foregoing invention has been described in some detail by way of illustration and example for purposes of clarity of understanding, it is readily apparent to those of ordinary skill in the art in light of the teachings of this invention that certain changes and modifications may be made thereto without departing from the spirit or scope of the appended claims.

SEQUENCE LISTING (1 sequence)

SEQ ID NO: 1 - DNA, 1830121 bp; double-stranded, linear
ggccgcggtgcatcacaaaacatcattccatcttcaacaggtgcagcgaaagcagtaggtaaagtattacctgcattaaacggtaaattaactggtatggctttccgtgttccaacgccaaacgtatctgttgttgatttaacagttaatcttgaaaaaccagcttcttatgatgcaatcaaacaagcaatcaaagatgcagcggaaggtaaaacgttcaatggcgaattaaaaggcgtattaggttacactgaagatgctgttgtttctactgacttcaacggttgtgctttaacttctgtatttgatgcagacgctggtatcgcattaactgattctttcgttaaattggtatcttggtacgataacgaaacgggttactcaaacaaagtattagacttagtagctcatatctacaactacaaaggctaattaaaactttgaaaaaattaaccgctcttcggagcgttttttattatctagaatttaatttacgctctaaaaatgaacaagggatcactaaaaataatttaaaacaatcaatattcttctagcttttattcctatttaagattatattagcgcacaactgttcgctcaatgaaaatcaaaaatagggttaatatgaatctcgatctccattttgttcatcgtattcaacaacaagccaaaactcgtacaaatatgaccgcacttcgctataaagaacacggcttgtggcgagatatctcttggaaaaactttcaagagcaactcaatcaactttctcgagcattgcttgctcacaatattgacgtacaagataaaatcgccatttttgcccataatatggaacgttggacaatcgttgacattgcgaccttacaaattcgagcaatcacagtgcctatttacgcaaccaatacagcccagcaagcagaatttatcctaaatcacgccgatgtaaaaattctcttcgtcggcgatcaagagcaatacgatcaaacattggaaattgctcatcattgtccaaaattacaaaaaattgtagcaatgaaatccaccattcaattacaacaagatcctctttcttgcacttgggaaagttttattaaaacaggttcaaacgcccaacaagatgaactaacccaacgcttaaaccaaaaacaattatcggatttatttacgattatttatacctcaggcacaacgggagagcctaaaggtgtcatgttagattacgctaatctcgctcaccaattagaaacacatgatctttcacttaatgtgacagatcaggatatttcactttcttttttaccattctctcatatttttgaacgggcatgggcggcttatattcttcatagaggcgcaatactttgctatttagaagacactaatcaagtgcggtcagctttaacggaaattcgcccaactttaatgtgcgccgtaccacgtttttacgaaaaaatttatgctgccgtattggataaagttcaaaaagccccaaaacttcgccaaattatgtttcattgggcaatttccgtgggacaaaaatattttgatctacgtgcgaataacaaagctattccgttcttattgaagaaacaatttgctttagcagataaattagtgctctcaaaacttcgtcaattattggggggacgaataaaaatgatgccttgcggaggagcaaaattagaaccggctattgggctatttttccatgctattggtatcaacatcaaattaggctatggtatgacagaaacaactgcaaccgtttcttgctggcatgatttccaatttaacccaaattcaatcggcacactgatgccaaaagcggaagtgaaaattggggaaaataatgaaatccttgtgcgtggcggaatggtgatgaaaggctattacaagaagccagaagaaacggctcaagccttcaccgaagatggtttcttaaaaactggcgatgcaggagaatttgacgaacaaggcaatttatttattaccgatcgtatcaaagaattaatgaaaacctcaaacggcaaatatatcgcaccacaatatatcgaaagcaaaatcggtaaagataaatttatcgaacaaattgcgatcatcgctgatgcgraaaaatatgtatccgcgcttattgtgccttgctttgatagtttggaagaatacgctaaacagctcaatattaaatatcatgaccgtttagaactactaaaaaattctgacattctgaaaatgtttgagcatcgtattaatgcggtgcaaaaagaattggctcatttcgagcaagtaaaaaaattcacgttactttctcaagcattcagcattaaattaggcgaaattacaccaacattaaaattacgtagaaaagtgattttagaacgttatcgcaagcaaattgaagcaatgtatcattcacaagaagcatagctaaaaggctctcaattgagagcctttcttttctaattattcaggaaatttttcttctaaaatcaatgcaagtccatcttcattattggttgccgtaaccacatttgcagcttgtttaatttcatttggcgcatttcccattgcaacaccaagccccacatgttctagcatatccagatcattaaaattatcgccaaatgcaatcacttcattagtttgtacgccaaaataatcttccaaaaaacgcaccgcacttcctttggttgcactcttgtgcattacctctaaaaaattagcgtgggaacgacaaatacttaaatgtggaaatttttcctttaaaagaacttcaatctcaatgatttcttctgcttccccaataatttgaattttatgtggcgaacgtgtcgctacttcatcaaaaggatgaatctcaattttggtcacgctgcgttcataaatcacccatttattttctacatcgcgcgcatggcaatcattatttgtataataattcacgccaagcaaaggatgttccgccaaaacagtattaatctctaaaatatcttttggctcaatttgtacgctataaattggttcgagattttggttcaaaataagcgcaccactaaatgcaacaagtacattattcgtttcaagctgtttccaataaggcaaaatacctaaaggagaacgcgccgaaattggcacaaaaggaatgccattcgccgttaaacgcttaattaccacaacagttcgaggggaaattgtatgttgagaggttaataaggtgccattaaaatcactaaatactgctttatacatcattactccgaataaagattatttctctgctagataaggatcatcaaagcctaatccttgcataatttgggtttctaaactttccatttcttccgcttcatcgtcttcaatatgatcataaccgagtaaatgtaagctaccatgcacgaccatatgcgcccaatgtgccattaatggtttctcttgttctgaggcttctcgctccacgacttgacgacaaataacgagatcccctaacaatggcaactccacctcatcggggcattcaaatggaaatgaaagcacgttagtcgggcgatcttttccacgataagttaaatttaattcatggctttcggcttcatccacaatacgcaccgtcatttcgacttcattgccctcaggctgaacagcacctgttgcccactgcacaatctgctcttctgttggcaaaccctctatattttctgtggcaatttgcaaatcaaccaatacacttcccattctattctcctaaattcttttcaatttctaaccgcacttttgcacttattgaatacatataacaaacggtgggcttatgaccacttttgtatgtgtaaaaatgaggggaattatacaataataaacctaccaatcccctaaatttagattacataatttatgtttaccgctaatttactctatttttaacgtacaaagagacaaatcacgctatttccttaatcaacacaaaacctcaaatctctcgctcttggttgaggttaattgtgaagtcgtagatgtccgctataaatatttccttttccttccctagcaaaaccaattaaagtcaaattatgtttttctgccattgttactgctaaatccgttgcggcagaaatcgtgactaacatttccaccccgcaagccactgttttttgcaccatttcataactcgctcgactggaggctaaaataaaacctctaggtttacccgattttgcgtgccaaccaagcaatttatctaatgcaacgtggcgacccacatcttcgtaaatagctaacatacttccatataaatcgaaaaatgcacaagcatgggtagcaccagttttacatccaagcaattgatttttttgaagatcaataagacaactatctagcaaatttaaatcaaattgaaaagtacagtctaatttcggaaaagttttatatacttgattcaattgttctgtaccacaaataccacaaccagtacgccccgtaagattacgacgatgctcttttaatgccataaatttacggctggaaagttcaatttgcacttcaataccattgcaaacttctacaacatcaataccataaatatcttctggtttattgataattccctctgttagagaaaagcctaaagsaaaatcctctaaattgtttggggaacacatcataactgcgtgagaaatgccgttatataccaaagaaactggtatctcaacagccagtatgtcctctttttgttgcaaaagtgcggtcaattttnctgtattttttgtctttctaaaaaagttgatagtttgtcgaatccagcactgcatttattaccagtccattagttaaatgtaaaaagtctgttaaattatttttatatttatgatctagatcacaatatttgttgaagctaatgtcatttgattatggatttatcgttaaaaaatcgttactctagccatccaataaatcaacgtttttacgatgatttatatactagagagtattattttaacgaaatcaacataatctagctactaaacgaattttattactatctataatatctcaacaacttgttgttgaaaggagtgattatgcaggtctcaagaagaaaattcttcaagatctgtgcaggaggtatggcgggaacgtcagctgcaatgttgggctttgctccagcaaacgtattagctgcgccacgcgaatataaattattacgcgcgtttgaatcccgtaacacctgtacatattgcgctgtaagttgcggtatgttgttatatagcacaggcaaaccttacaattcattaagcagccatactggcacaaatactcgttcaaaactctttcatattgagggtgatccagatcatccagtcagtcgtggtgcgctttgcccgaaaggtgctggctcactcgattatgtcaatagtgaaagccgttctttatatcctcaatatcgtgcgccaggttctgataaatgggaacgaatttcttggaaagatgccattaaacgtattgctcgtttaatgaaagatgaccgagatgccaactttgttgaaaaagattcaaatggaaaaacggttaatcgttgggcaacgacaggaattatgactgcatcagcaatgagcaatgaagctgcgttattaacacaaaagtggattagaatgctcggtatggtgccagtatgtaaccaagcgaatacttgacacggaccaacggtagcaagtcttgctccatcatttggtcgcggtgccatgacaaataactgggttgatattaaaaatgccaacttaatcatcgttcaaggcggtaaccctgcagaagcccatcctgttggcttccgttgggcaattgaagcgaagaaaaacggtgcgaaaatcatcgttattgatccgcgttttaaccgtacagcatccgttgctgatcttcatgcgccaattcgttctggttctgatattacgttcttaatgggcgtgatccgttacctattggaaacaaaccaaattcaacacgaatatgttaaacactataccaacgcatcattcttaattgatgaaggtttcaaatttgaagatggtttatttgtagggtataacgaagaaaaacgtaactacgataaatctaaatggaactaccaatttgatgaaaatggtcacgctaaacgtgatatgacattacaacatcctcgttgtgtcattaacatcttaaaagagcacgtttctcgttataccccagaaatggttgaacgtattacaggcgtaaaacaaaaactcttcttacaaatctgtgaagaaattggtaaaacctctgtgccaaataaaacgatgacgcatctatatgcattaggttttacagagcattcaatcggtacacaaaatattcgctcaatggcgataatccagttacttttaggtaatatggggatgccaggtggcggtattaacgcattacgtggacactccaatgtgcaaggtacgacagatatgggcttattgccaatgtctttaccaggttatatgcgtttgccaaacgataaagatacctcttacgatcaatacattaacgcaattacaccaaaagatatcgttccaaaccaagtgaactattatcgtcatacttcaaaattctttgttagcatgatgaaaactttctacggagataatgccactaaggaaaatggctggggattcgatttcttaccaaaagcagatcgcctatatgawccaattactcacgttaaattgatgaatgaaggcaaattacacggttggattttacaaggttttaacgtattaaattcactaccaaataaaaataaaacgttatctggtatgagtaaactgaaatacttagtcgttatggatccattacaaactgaatcatcagagttttggagaaattttggtgagtcaaataatgtaaatcctgcagaaattcaaacagaagttttccgtttaccaactacttgtttcgcagaagaagaaggatcaatcgttaattctggtcgctggactcaatggcactggaaaggttgcgatcaaccgggagaagccttacctgatgttgatattctttctatgctacgcgaagaaatgcacgaactttataaaaaagagggtggacaaggaattgaatcttttgaagcgatgacttggaattatgctcaaccacactcaccaagtgcggttgaattagccaaagaattaaatggttatgcgcttgaagatctttatgatccaaacggtaacttgatgtacaagaaaggtcaattactcaatggatttgcacatttacgtgatgatggtacaacaacatcaggtaactggttatatgttggtcaatggactgaaaaaggcaaccaaactgctaatcgcgataattcagatccatcgggtttaggttgtactattggctggggctttgcatggcctgcaaaccgccgcgtactttatagccgtgcatcattagatatcaatggtaatccttgggataaaaaccgccaattaatcaaatggaacggtaaaaactggaactggtttgatattgctgactacggtacgcaaccaccaggttctgatactgggccgttcattatgtccgcagaaggcgtaggacgtttatttgccgttgataaaattgcaaatggcccaatgccagaacactatgaaccagttgaaagcccaattgatacaaacccatttcatccaaatgtagtaaccgatccaactttacgtatctataaagaagatcgtgaatttattggttcaaataaagagtatccatttgtagcaacaacttatcgtttaaccgagcatttccacagctggactgcacaatctgcattaaatatcatcgcacaaccacaacaatttgtggaaattggcgaaaaattagcggcagaaaaaggcatccaaaaaggcgatatggtaaaaattacttctcgtcgtggctatattaaagcggtcgccgtggttacaaaacgtcttaaagatctcgaaattgatgggcgtgtcgtacaccatataggtcttccaattcactggaatatgaaggcattaaatggcaaaggtaaccgtggattctctacgaataccttaacaccatcttggggtgaggcaatcacgcaaacaccagaatacaaaacattcttggtaaatattgaaaaagttggggaggcataatatggctggaactgctcaaggcgttcaaacgcaagacgttattaaaatctccgcaacatctggtttaacaccagcaccacaagcgagagatcataaagttgaaatcgcaaaattaattgatgtttcaacttgtataggatgtaaagcctgtcaagtgggttgttcagagtggaatgatattcgctctgatatcaatgcacaatgtgttggggtttatgacaatccagttgatcttgatgcaaaagcatggacagtgatgcgttttaacgaagttgaagaaaacgatcgtttagaatggctgattcgtaaagatggctgtatgcactgcacagaacctggttgtttaaaggcttgtcctgcacccggtgcaatcattcaatatgctaacggtattgtagatttccaatccgataaatgtattggttgtggttattgtattgcaggctgtccattcaatattccacgaatgaatcctgaagacaatcgtgtatacaaatgtactctttgtgtagatcgtgtttctgtgggacaagagcccgcttgcgtgaaaacctgtccaacaggtgctattcgtttcggctctaaagaagaaatgaaaatttacgcagaacaacgcgtggcagatttaaaatcccgtggttatgaaaacgcaggactttacgatcctccaggtgtaggcggtacacacgtaatgtatgtkttgcatcacgcagataaacctgagctttacaatggtcttccaaaagatcctcaaattgatttgagtgtgaccttatggaaagatgtattgaaaccagtcgctgcagttgcaatgggtggtctagctctagcagaagttgcgcactacttaaccgttggcccaaatgtagaagaagatgtggaagatcatcatcacgaatttgaagaaaataaaccatctaagggggaaaataatgagtaaaattgaaattagcaacgatactcgcattatccgccatagaaccccagcacgtatcagtcactggatgttggttatttgcttttttatgacgatgttcactggtgttgcatttttcttccctgactttgcttggctcacagaaattttgggtacaccacaaattgcgcgcgccattcatccattcacagggattttaatgttcttcgctttcatctacttagcgttattgtactgggatcacaatattccagaaaaaaacgatattcgctgggcgaaaggtgttattgaagttcttaaagggaatgaacacgcggttgctgataatggcaaatataaccttggtcaaaaaatgctcttttggacattaaacttggcaatggtaacgttattagtcactggcatcattatgtggcgtcaatatttttcacattacttctcaatcccagtattgcgaattgctattttactccactctgcaagtgcttttatgttattcactggtatcttagtgcatatatatatggcattttgggttaaaggatcaattcgcggtattgttgaaggttgggtaaccgttcgttgggcgaaaaaacaccacccaagatggtatcgtgaagaagttttatcaaaacttgaggaagatttactcaacgagcaatctggcaaagtaggtaaaaccaaagtcttatttaaaggatttggcaaataagctgaaatcctgaaaaagaaaaagtgcggttaaaattgaccgcactttttattataaaagtgagagaatatgagtatcaaaatcttatctgaatcagaaattaaacaagtagnaaattcatatcaagccccagcggttttatttgccaatcctaaaaatctttaccaacgcagagcgaaacgtttaagagacttagcacaaaatcatcctctatctgattatttattatttgctgcagacatagttgaaagccaactttccacgttagaaaaaaatcctttaccgccacaacagcttgaacagttaaatactatcgagccactaaatgccaaaacctttaanagaaacagtatctggcgtgaatacttaacagaaattcttgatgaaataaagcccaaagctaacgagcaaattgctgcaacaattgaatttcttgaaaaagcctcttccgctgaattagaagaaatggcaaataarckcttagcacaagaatttaacttagtcagcagtgataaagccgtctttatttgggctgcactttccctttattggttacaagcagctcaacaaattcctcataatagccaagttgaaaacgctgaaaatttacatcactgccctgtttgtggttctttacctgtggcaagtatggtacaaattggtacatcacaaggtttacgctacttacattgtaatttatgtgaaagtgaatggaatttggtacgcgcacaatgcaccaattgtaatagtcatgacaaactcgaaatgtggtcactaaatgaagaacttgcgcttgttcgtgccgaaacctgtggtagttgtgaaagttacttgaaaatgatgttccaagaaaaagatccttacgtagaacctgtagccgatgatttggcttctattttcttagatattgaaatggaagaaaaaggtttcgcccgaagtggattaaatccatttatttttcctgcagaagaagcataaaaatatagcctagaaatatctaggctaattatttaaatctatagataacacgccattaccactgcattttctcgtccaccactgggtttcggataataatttttccgaatatccacttcattaaaaccaattttttcatacaagaaacgagcagagttagactctctgacttctagccataaggtttggacacctttttcctttaattgaaagattaattttcctaacaataatttgccaaatccacaaccttgataagtaggcaaaatcgcaatattaaacaaagtcgcttcatccaatactgtttggcaaatagcaaaaccgataatctgattattctctattaattttaaattgagataacgctccccttgattattttttaacgtaccaaatgaccaaggcaccagatgggcttgctgttcgatttcatacaatcgctcgaaatcacaggcttcaatttgagaaataatagacataattaaggctgctgaatttgttgccacaacgctcgtttggcttgatgattagattgaaattgctgccaacttggcgagcgataaacctgctcagcctgcttgcaaaatggcaaagtgcggtcaatttggtcgctattttctgatagtaaccaataacgaataggctgtttacattccatatgctggatttgatcgtaattcaaacataaacaattttcttttttaagattaaggcttaacagcacatcagccaacaaaggcgagctactgatattttcatcggaaacagtgataaggcgaatattctctgccacactaattcctactgaaccttgcagtacctcggggcgatataattcccactgggaaatgcccatttcttgtaaaagaagatcgcgtctgttcataagtgaatttttaaaaacgttgcttgaaaaatagtgttaatttcttttattaatctttgctaaaatggtgcgtaattttaaccaataacccacaggattcaaagcgtgatttctctagaaagccaagttttagaacgccatatttcattttttgatggtaaatcggtattatttgctggcggtatttctgatagttttcctcaaacattagcctcaaaatgctcatcaatccaaatttggagttgctattttgactatgcaagaacacaaagtgcggtcaatttttccgttgaatttcaaggtcaagcggatttaatcgtttattattggactaaaaacaaacaagaagtcaatttccaactgattcaactattagctcaagcatctattggtcaagaaatattaattattggtgaaaaccgttgtggcgtgcgttcagtagaaaaaacattatcaccctatggagaaatagcaaaaattgactctgctcgtcgttgcggtttatatcatttttcactccaaaataaaccgcactttgaacttaaaaatttctggagaacctaccaacattcaacacttgaaaacttaactatatatagtttacctggggtatttagtgcggcggaattagacacaggcacagaactgttactttcaactattgataataaaataaaaggaaaagtgcttgatcttggctgtggggcgggggtaattggctctatgataaaaaaacgcacgcctaacgcacaaattacaatgacagatattcacgcaatggcattagaatcagcgcgtaaaacactttctgaaaatcaattacaaggcgaggtttacgccagtgatgtcttttctgatatagaaggaaaatttgatttgwtcatttctaatcctccattccacgatggcattgataccgcctatcgagcagtgacagaactcatcactcaagcgaaatggcatctcaatcaaggtggagaattacgcattgtcgccaattcatttctgccttatcccgaattacttagacaacatttcaatgattatcaagttcttgctcaaacaggaaaatttaaagtgtattcagtgaaaaattagaaacaaaaaaatccccatcacaataatggggatttttattatgcgtataaattttaccgcattttattcatccatatatcctaaactacgcagcgcacgttcatcatcagcccaaccagatttcacttttacccaaagttcaagatggactttgttatcaaataaacgttccatatcggctctagcttccataccaatagttttaattttttgaccgcccgcaccaatgaccatttttttctgaccttcacgttcaacgagaattaagccatttatttcataagtgccacgttcatttactttgaattgttcgatttcaacagtaacagaataaggcaattcttcaccggtaaaacgcattaatttttcacggattatttccgaggccataaaacgttgcgaacgatctgtgacataatcttctggaaaatgatgcacaccttcacgtaaagattggcgtacaattttctctaattcatgaacattattaccacgctgtgcagaaattggcacaatgtgagcaaagttaaatttactgctaagatctgtaataaacggcaacaaatcatctttattcttgatgttatctactttgttgatagcaagcacaacgggtgcttttgcattacgtagtttgtttagcaccatctcatcatctgcattccagtgtgtaccatctacgacaaaaataattaaatcaacatcgccgatagcactacttgcggcgcggttcattaagcggttaatcgcccgtttttcttcaatatgaagccccggtgtatccacgtagatttcttgatacgcaccttcagttttaatcccaacaatgcggtgacgggtagtttgtgctttacgcgatgtaattgaaattttttgtcctaaaattttatttaagagcgttgatttacccacatttgggcgacctacgatagcaataaagccgcaataggttttgtcgaattgttcggtcatttgatgtccagttcttttaaaatttgttctgctgccgcttgttcagctttacgacggctagatccttttgccacaaaagtgcggtcaattttctccgcacttttcactttgcatttaacagtgaaaatttggcaatgggcttccccttgaatattgaccacttcataagttggcaatggcaaatgtttgccttgtaaatattcttgtaaacgcgttttcgcatctttttgattatcgcctggtttaatttctgccaataactgttgataccaatttcgtatcacttgggtcgtcacagccaatccttgatccaaagacattgcacctatgatcgcttctacacaatcggcaagaatagattcacggcgaaaaccaccgttctttagctcgccagaaccaagcgacatataatcgcctaattcaaattggcgcgctaaaatcgctaaagtgggttcgcgtaccaaagtagcacgcatacggctcagttctccttcattacaacgtggaaactgatgataaagtgcttcagcgatagtgaaattaagaatggaatcgcctaggaattctaggcgttcattatgttgagttgccgcacttcgatgcgtaagtgcctgctttaagagcgctatatcattaaaacgatagccgattttacgctcaagtcgatctaaatgattcatcttattttattgctgtaaagaaacgctcaaaacggaaacctgttggccattcattcgcttctttttctaagctcatccaaatataagtggctttacccacaatatttttttcaggtacaaagccccagaaacgactgtcatcgctgtgatcgcgatgatcccccatcacaaaatactgcccctctggcacaagccattctgcagtttgcattccctcttgtgggaaaaattcaaggtctgaataacgacgatactcactaattaacacgttatgtgttacatcgcctttttcagtcaattctaattcatttggaaaagcaggatttgttggattttgtgtatattcaaacgccttagtttcgcaatcaatttcacagggtttcccctctttaccatataccacttttagcgttttttgttccacatcaaaaatgacgcgatctccgccctttccaacaatacgcttaatataatccacaccagacatattatcttttgaacttaacgctaaattttctgcaaaagccgctcgtgttgccccaagaccagtacgaattaacgcttgttgtggtgctttaaacacaatcacatcgccacgttgtggtttttcgcctgcaataatggtgttttggaaaatcggatctttcacaccataagcatatttattcacaactaaaaaatcgccaacgcgtaaagtggactccattgagccagagggaatttgaaacggttcaaacaaaaaagaacgaaccaaaaataccactgcaagcacaggaaaaagtgaagacaaaaattctgaagcctcagaaatcggttcaattttggctttttcttcctcacttaaggttttaccagaacgttgttctgcacgtgccacttgacgatgacgttttggcagcaccacaaaacgatgataacaccataatacgccagaaagtgcggtcaaaattagtaacaaaatactaaaagtatttggtaactgaaaataatctaaaactttccacacaccaaagccgacagccaataaaatcacaaaaaataaatttgacataattttccttatttatcttttcctacgtgtaaaattgctaaaaacgcctcttgcggcacttctacgttacctaaagacttcatacgttttttcccttctttctgcttctgtaagagttttttcttacggctcacgtcaccaccataacattttgctaatacgtttttacgtaattgtttcaccgtagaacgagcaataatatggtttccaatcgctgcttgaatagcgatatcaaattgctgacgaggaattaactcacgcattttttcaaccaattcacgaccacgatattgtgaattatctttatgaacgattaaagccaacgcatctactcgttcgctgttaatcataatatccacgcgaaccatatctgccgcttggaaacgtttaaaaccgtaatctaacgaagcataaccacgcgatgttgattttaaacgatcaaagaaatctaaaaccacttcgcccattggaatttcataagtcagcgcaatctgattaccgtgatataccatattggtttgcacgccacgtttttcaacgcaaagggtaataacgttacctaaatattcttgcggcaccagcatattacattctgcgattggctcgcgaatttcagcaatattattaagtggaggcaattttgcaggactatccacataaaccacttcaccattggtcatttcaacttcataaattacagttggtgctgtggtaatcaaatcaagatcgtattcacgctctagacgctcttgaatgatttccatatgcagaagtccaaggaaaccacaacggaaaccaaaaccaagcgcggtcgaagtttctggttcatagaaaagtgacgcatcgtttaaacttaatttaccaagtgcatcgcgaaacgcttcataatcatcagaacttacagggaaaagcccagcataaacctgtggttttacttttttaaagcctggtaaaacctcagttgcagaattatgttgatgggttaaggtatcgcccactggcgcacctaaaatatctttaatcgcacaaacaacccaacccacttcgccgcattctaaaacggtagtatcttcttgttttggcgtgaaaatccctaaacgatctacgttataagtttgccctgtggacatcactttaattttatcgcctttacgtaataccccgtttttaatacgcactaaagataccacgcccaaataattatcgaaccaagaatcaataatcaatgcttgtaatggcgcattaggatcaccttctggtgcaggaatttttgccacgatttcttctaatacatcttcgatacctacacccgttttagctgagcatcgaaccgcttccatcgcatcaattccaacaatatcttcaatttcttcagcgacgcgttcaggatcagcagctggtaagtcgattttatttaaaatcggtactacttctaaatccatttcgattgcagtataacagtttgctagagtttgggcttctaccccttgaccagcatcaactaccaacaatgccccttcacaagcagcaagagagcgagacacttcataggaaaagtccacgtgtcctggtgtatcgataaagtttaattgataagtttcgccatctttggctttataatttaaagtaacactttgtgctttgatggtaattccacgctcacgctcaagatccattgaatctagcacttgcgcttccatttcacgatccgaaaggccaccacaagtttgaatcaaacggtcagaaagtgtcgatttaccgtggtcaatatgggcaataatagaaaagttgcgaatattcttcataaaagattgtttttctcaaaaatcattaaatttaactggcggattgtacctgaaaagcgcggaaatcgctagggatgaaagggaaaagtgcggtcaaattttcaaactttttagataaaacaaaaccccgaataacttcggggtttcttttttcattcaaactgaaattataggctttcagtgaaagtacgagtgatcacgtcgcgttgttgttctggcgttaaagagttgaaacgtactgcgtaaccagaaacacggatagttaattgtggatatttatctggattgtttaccgcatcttctaacgtttcacgacgtaatacgtttacgtttaagtgttggccaccttcaactttaacagttggtgctacgtttactggtaattcacggtattcgatttgacctaattcgctaactgcaacaacttggtcttcagcgaattcgccttttgcacataagcaacgtgcttcatttttttcgctgtctaataaccagaatgaattaagcaaattgtcatttgctgcttgagtaatttgaatacctttaatcataatagcctcctaattggcacgaaaataataataaaactgtacaaattttatcaaatcattttaatatttcaaattattttatatttatttgataaagagcaggttatttttttaattaatttttataaatttgatctaaattaaaattcattaatttttaaataaaatttatatcaataatttaacattaatttaactttttattgaatgaatgtttttgtttataatgaataaaaacttattaataggataaaataatgaaaaactggacagacgttatcggaacagraaaagcgcaaccttactttcaacacacactacaacaggttcatcttgcaagagcaagcgggaaaacgatttatcccccacaagaagatgtatttaacgcattcaaatatactgcttttgaggatgtaaaagtggtaattttaggtcaggatccttatcatggaccaaaccaagcgcacggcttggctttttcagtaaaacctgaagtagccattcccccttccctattaaatatatataaagaactcacacaagatatttcgggatttcaaatgccatcaaatggttatttagtcaaatgggcagaacaaggggtattgctacttaacactgtgcttaccgtggaacgaggtatggcacattcacacgccaatttaggttgggaaaggtttacagataaagttattgcagtactcaatgaacatcgtgaaaaactggtgtttttactttggggcagtcacgcacaaaaaaaagggcaaatgattgaccgcactcgtcaccttgttttaacggctccgcatccttccccgttgtcagcacatcgaggtttctttggttgtcgtcatttttccaaaacaaattcatatttggaaagccacggaataaaaccgatagattggcaaatctaaaccatatatctctaaaaaataaccgcactttaatctctcaaagtgcggttaaatatttcagtattttaattagccgtgataacgccctacgcctaattcatcttctttacgtgtgcgattcatcacttcttgtggagattgcgcaatacgtaatcccatttcatcttcagtacgcaccacttcgccacgtaacgaattagtataaacatcagtgattttcacatccacaaacttaccgatcatttctggagaaccttggaaattaacaatacgattcgtttcagtacgtcccgtcaattccataatatctttcttcgatgggccttcaactaacacgcgctgctctgtgccaagcatacgacggctaaattgtgccgcttgttgattaatacgctcttgtagcacataaagacgctgtttcttttcatcttccgtgacatcatctggcatatctgctgctggcgtacctggtcgggctgagtacacaaaactgaagctcatatcaaagtttacttgtgcaatcaaattcatagtttgctcaaaatcttccgccgtttcaccagggaaaccaacaataaagtcagagctgatttgaatatctgggcgcacagcacgaagtttacgaataatggatttatattctaatgcggtatgagcacgtttcatcattgttaatacacggtcagaacctgcttgcactggaagatgtaagaaactcactaattcaggcgtatcacgatacacatcaataatatcatcggtaaattctattggatgactggttgtgaacgtaaacggtcaataccatcaattgatgcgacaagacgaagcaactcagcaaagctgcaaatttgaccatcatgcgttggcccacgataagcatttacattttgaccaagtagattgacctcacgcacaccttgttccgcaagttgcgcaatttcaaatagcacatcatctacaggacggctaacttcttctccacgagtataaggcacaacacaaaaagtacagtatttattacagccttccataatggaaacaaatgccgttgggccttctgcgcgaggttctggtaagcggtcaaatttctcaatttcagggaaacttacgtctacgacggaactttttccaccacgaatttgattaatcatttcaggcaagcgatgcaaagtttgcgggccaaaaataatatccacataaggcgcacgatggcgaatatgttccccttcttgagaggctacacagccgcccacaccaatcactaaatttggattatttttctttaattctttccaacgcccaagttggtggaacactttttcttgtgctttttcacgaatagaacaggtatttaataataatacgtctgcttcttcaggtgcttccgtgagttctaatccgtgggtgcttaataaaagatcagccattttagatgaatcatattcattcatctggcagccccaagttttaatatgtaatttttgagtcattttctacaatatcgttaggtgttataaataattagttaaataaagcaatgggctattctacagcttgcgctaattctggctagtgaatattcggtgaaagacactaaacagaatattttgataagctagaaaggcttgtaaatcattaaaaaaataagatattcataaatatactcaagatataatgcagtatgaggtaaatattagttcataaaattaaaggaaatactagcttatcgcgattacaacgatgtgtatattcaaggtaaaccaaaaggattaagccctgtagattacaggacttaatccttaaattaaatagagctcactttttagtgaaagcgcaagcatatatttataatcaactactttgtctactacaccgtcaaaatagcagttaaatttaaaaaagattagcttataaccagcctaaactcattaataatttccaccatgccataccgatagttagatggataattaaactaccaaaagcaatgatcgcgccagtaatccaccaagattttatatcattataacctgcaccgaatgcaattggacctggtccgcctccgtagtgagttactgaaccaccataagaattagcaaagactaagcctagagcaagcaattcagtaggagcgcctgttacatgtccgactgttgcaaatacgggtaccattgcagctacatatgcaccgcctgatgcgaataaataacgtacagagacacttaaggtaagaatcactattaacgccatcataccatgtccctcaaactgaagtatggtacttaaggtgtttgctaaccatttgaaaaagccagatttttcaagcaagccagacataccgatgataccaccataccatactagggtattccatgcgcctttgctttttaggatatcgtcccaggtgacgatacttaatacaatacaaagcaccattacaatgattgcaacaatggtagcattgatatgaagtgaattagagaaaatccagccgaataatgcaattacgaataacacgctgagtgctttttcacgaaaagacattggacctaattcttctaagccttttttcgcaatggctttattatccacttttttcaattctggtggagatacccaataacaaattaacggaattaagaataagcagagtaagccgggtacggatgcagctaagaaccatttgatccaagtggtttcaaaaccaagaattggtgccattaatgaaagagctaaggcattaggagccattgcggttaagaaaatataagaggtagttttaaccaccatatatacgttcatcatcaaataacgccctgcttttttcgggcttttttctggatctgaaccaagagcaaccactacgctattaatgattggaaagataatcccacctgaacgcgcggtgttagagggcgttgctggcgagagtaaaagatctaagaacatggtaacatagcctaagcgtagggttgtgctacccattgcgccgatcatatgataggcgatacgtttacctagacctgtgattacaaatgctgaactcaaagtgaatgcggtaaaaataagccatgttgtgccagatttataaccatccaacatattgccgactttaaccaattctttcgccccttcagtattaccgatgataacgccagaaaccgcaattgcagccaataagataacgggctcgccataaggtttaagcacaagcccaacgatagtggcgatataaacaccaagtaatcgccaagcaatcaaagaaagcccatcaggagcaggtagtaagaaagtgatcaatgggatagccattaaaatcaccagttttgtatttttggataatgccatattaattacctctaaatgataaaaagaaaattgttagtgctaataaatcagcactaccgcccgaacttaaattacgttcaatgcaggcggtatcaaatttcattaatgcttgtgtcagtgctgttttatctgtcacaaggtgttgatctgtaagcagatcctgtgctgtttgctgtatgaaatacaatcccgctaaaccacctcgatgaaccacgttagtgtcggagttaattgccattaaattcaacaacaaaatcagtaaacgatgttcccattctaactgatggtactcatcaaattgtggcaacaacgtttgaatgagattaaaaccattttctgcttcgccacggacacctgttaagccatatttttggaataaacgcactccagccgtactaggcaagtgttcaggataatttttcagttcatccgttaaaccttgagtaaattgtgcaacaagtgagcagattaatttaacatcaaaatctaccgcactttgaaccaaacttttttgtgccaataatcgtccaattgccgtacacactaaaccaaaagaaaaaatagctcctttgtgggtgtttacgccatcagtaactttaaacattgctttttctgctaataaacctaaaggacgaatttcagagagaatttgattttcagacaaatgcgcggtcatcatgcctttgagaacaaactgcgtaaaaaaaggttttaaactaatcgcactttgctcaaaagtatgtaggttcatatctttgtgcgaaccgttattgatggcatccactaaaccaggttttggcgataagcgagcctcttgtattaatgccagataaacttgttcaccaatatgttctgcgaaatcatgattctgtgcgagagattgaattttatctacaatctcatcaatctcgtgcttgtgggttctcgcacagatttttgcattttctccgcacactaaacaagttcttggagaaagatcaaaatctgtacgactcagtagattgcctttagcattaaacacatctaaatcccacaaacgagcaagaggaatactttcttccaattcaatcatcagaacttttagcgtacgagcatctatcggtaatacaaaataggcttcatgccccgtttctagcggacggattatttcttttactgctgtgatgtttaactgagtaaaaagtgcggtcagattttctagagcttttgtaaaaacataatccaacaaagcatttttttttactccacccacagcagttaaagtgatgcaaagtaaggtttgtccatattgtgttataagctgttgttgtaaaattgcacgttcctctcgagcattaagcaatgcttcaagtgaaatttttgaaccctctgtagagaatgtcgtaaaaaaatgctgcaaaatttgaccgctcttttgtataaaaataaattttcttaactctttccatttatatggtgctggcgaaagctgaaagagctaattgagtccctttcaactctttgggctcctttcctgataatcatgggaagacaagagttaattttggctattgaaagtagatcgcttgtaatgctgattctagtctttaacttgatacaccgtatcaatcaccgaaccatcacgataacgaacaacagccacaggtttattagtaaactcaatttcttttggtttaccagtaatgctgtaagcacgttcacaaagttgttcaatagtaaacaatggaatgtctgttttgcttaaagcttcaatcaaatctggacgtttaggatttactgctacaccatgatcggtaacgagaatatcgacgttttcaccaggtgttacacaggtaatcacgttttccaccacggttggaatacgaccacgaactaatggtgccacaatgattgctacttgtgcagaagctgcggtatcacaatgaccaccagatgcaccgcgaatcacaccgtcagagccagtcaatacattcacgttaaatttagtgtcgatttctaaagcagaaagaatcaccatatctaaacgttcaacagatgcgcctttggaactgtaattcgcatattggttagcggagacttcaatatgatttgggttacgggcaagtgattcagctgcaacagaatcaaagctttgtacatctaataattttttaataagaccagcctcatgtaatgccaccatacttgcagtaattccgccaagtgcgaaatctgcagtgatattttcacgacgcattttttcttctagaaagcgtgtaacagctaatgctgcccccccagaaccagtttgtaatgagaagccatctttaaaataaccactggcaaaaattacttctgcacatttacgcgcaatgagtaattcgcgtggattggtagtcattcgggttgcaccaccaccaatttttttcgggtcaccgactgcttcaacttgcacgattaaatctacttgatcttgagctatgctgattgggtggtgcgggtattcaacaaattcctctgtgagcaacacaactttgtcagcatattcagcatcgacacgcgcatagcctagagagccgcatttactttttccagtaaatccattggcattaccgaatgtgtcacagcaaggcacgcctaaaaaagcaacgtcaatttttaattcgccagattttactaagtgaacacgtccaccatgagaatgaatatttacaggttcattcaataaaccgcgagagatttgctctgcaagttcaccgcgtaaaccagaagaatagattttggtgaccacgccatttttgatatgttcgacaatcgggaagtggctatcaattaaagatgaagatgcaagggtcagatttttgaaacccatttcggcaattttattcatcaccatattcaccacaaaatctccgccccgaaaagcatgatgaaatgaaacagtcataccatcttttaagccagagcgtttaatcgcttcttctagagaggtacaaagtttgcgatctttcgctgtacgagaaagggattcagatttaggcaccgcttgatagactgagcgatcagcgtgatatttttcaatacgttgttctcttgttgtcatctttttatctccctttactcttcacgaatacctgatttcgcacgttctaatacaagttttgcgcgatcaataatcggtgcgtcaatcattttaccgtttaacgaaacaacaccagccccttgtcgttcagcttctactgccgcttcaataatgcgttttgcctgctccacgtctttttgtgtcggtgcaaataagttgtgtaacaattcaatttggcgtgggttgattaaggatttaccgtcaaaaccaagctgtttaattaacgcagcctcttttaagaagccttcttcattgttcgcgttagaatatacggtatcaaaagcctgaatgcagccgcacgtgccgcttgtaaaatagaacaacgagcaaaaagcagttcaatcccctctggtgaacgctcggtttttaagttacgtacgtaatcctctgcacccaatgcgataccaattaaacgtttagaagcgaaagcgatttggttggcttgagtgatacctaatggcgattcgattgcggctagcattttagtcgaacctgcttctcgaccgcaagctttctcaatctcagtaatggcgtgatccatatccaacacatcttgcgcgctttcagtttttggcatacgtaccacatccacacccgcacgcactaccgaattcaaatccaataaaccaaattcagaatctagcggattaacacgaactacggtctcaatttctttataaagcggatgttgaagtgcatgagcgactaataaacgagcagaatctttttctttgagagcaaccgcatcttctaagtcaaacataatggaatctggtttataaataaagctattacttaacatggcggcatttgagcccggcacaaataacatacttcttcttaatttcatagcacagcctcccagttaatcgcttcatcagttgcacgcattgcagcagcttttactcgagcttgtaacacgcaatctaacgcccctttgtcttctacaatgacttgtgctgctgtaatgcctagttttgctaatacttcacgaactgtcgcttcaatttgttcaccaaattgttttgctactgagctattgatttcaatatcgagtgagtcaaaaggttgaacccgtacttgaacatcactggattccagtgtccctgcaacggctacttttgttattttcatagattttccttccgtatattgatgaataaaaatgtatttaaaaacgaccgcacttttgtaaataatttaacgtagtcataggcacaaactctgcgagttgagcccaatttttttcagccaaatgctttcgtactgtagaagcagaaataatgtggttgcttgctgtttttctaggtatctcgataacatttatttttggtgcattcatttcggcatccattaaccaataatgcatttggcgattatattcggcagtgacgggacaatttagctcagtaccaacaaagcgatgtgttattcccaaagcttgagcaatatgtaaacggaataacttcagatcaatctcaaaataactttcatctgtaattaattgatcttttaggaaataatttggaaatgttgcacgagaaataatatagtcagagccagaatgaagagtgatattggataaatcgaaaataccttgttgaatcatttcaaatcgttcagtgtaagaaaattgcgatgcgtcttcaccgacaataaataaatgcagatgatcacattgttgtaatgcttgctcaattaaataacgatgacctaaggtaaatggattcgcgttcattacaatcgagccaattcgattaccatccacacgcattttctcccataatgagcattgtttttgtaaacgcgtagcactattttctaataatactacataaggattggcatcagagatgatataaaaaccacaagatttgaacaacgttgcatattcgggttttgtataaataaaaaggtgtggacgttttagcgtgtaagctaaatcaaccaattcagtaattaattgcaaggcaacaccgctaccacgcaaagactcatcaatcgcaacacattttatgatattgcctgctaaaccgccacagacaacgatttgttcgttatcattatagccaacaacaaaatactcgatttgttcatctaatttaagcgcattttgatgtaaaaatgtctgaatgagagaaagttttttttgttcagtagaaattcgctcaaattgcatcgactctccaaaaaagaagaaaacataacatcactaccaagttagtagtatagagctattataagcgatgagcaaattacgatacaagataagctcatatttttcccaactttataatctaatattatcttcacactgcattatacattgaataatttataggcaatattggcggttattctgagttgtaaaaataaaccgcacttttgttgcaagcaaaaagtgcggtttaatttagcggaattttaaattatttcactaatccgccactggcttgtaaatcagcgtgataagaagaacgaacaaatggcccacaagccgcatgttcaaagcccatttcattggctttatcacggaattcatcaaattcagttggcggcacataacgggcaacaggcaaatgatggcggctaggttgaagatattgacccaacgtgagcatagtcacaccgttatcacgtaaatcttgcatcacttgcaaaatttcctcgttggtttcgcctaacccaaccattaaaccagatttggttgggatatttgggaatatttctttgaattcacgcaataatttaagtgaccattcgtaatccgcacctggacgaatttctttatataagcgcggtacgttttctaaattatggttaaagacatctggcggattatcttttaatttctctaaagcctgtgtaatgcgaccacgaaaatcaggcactaaaatttcaatcttaatgttaggattaagctcgcgcacagcttttacacattcagaaaaatgaccagcaccacgatcaggcaagtcatcacgatccaccgatgtgattaccacatatttaagtttcatatcttgaatcgtttctgccaatttttgtggctcttcaggatctggcggtaatggtttaccgtgagccacatcacagaatgggcaacggcgcgtacaaattgcacctaaaatcataaaagtggctgtgccatgattaaaacattcgtgtaaatttggacaagatgcttcctcacaaacagaatgtaatccgtgacggcgcattccatttttaatgctttcaattttagctgaacttgctggaagtttaattttcatccattctggtttttttaataaatcttgattaggatcgatattttttacgggaataattgaggtttttgccgcatcgcgatattttacaccgcgttccattttgaaaggcgtagacatagtattttcctaaataaaaatgcccaaattgggcatttagtttttataaaatgttataaagttgttatattatagcctaaaagattggcgaagtgtttaattaattttgctgaaacattatcgcaatcagctttatcttgattaacaaaatccgctaactgacacatttcaagccctgcataaccacaaggattaatataatggaaaggattaagatccatattaatattcaatgccaacccgtgaaaagagcaaccacgacgaatacgtaatccaagagaacaaatcttttttccatccacataaacacctggcgcatcaggctttggatagctttcaatgccatattcagccaaagttttaaccaccgtttgttcaagtgcggtaactaattgacgtacatttaaatttttatggcgtttaatgtcaataagcacatacatcacttgctgaccgggtgcgtgataggtaatttgcccaccacgaaccgattgcaccacagggatttcactacgttgtaaaagatgctctggtttacctgcttgcccttgtgtaaaaacaggataatgttgtactaaccaaatttcgtcttgcgtttcagcatttcgagtatcagtaaaatcctgcattttgtgccaaatttcttgataatcttgcaatcctaactgacgaacgataagggaattgntcatactaaataaccattttcacgccttcaactttagccagttctttatagagtgtttctacctgatcaaagttttcagcaataatatcaattgaaactgaattataagtgcctttactactgcgcttttcttttggaatataatcgcctttaatatatttttgcaccacttgtataagatcttgtgctaacccttctcgattaattcccgcaactttaaaagtcatttttgctggaaattccattaattccttgagttttgcataatcgttttctattgtcattttctttcctaaaaataaaataaatcaaaaagtgcggtcaattttcaaattctttttatgagaataaccctttcacagtcaatactaaccaatcccatagtttaccaaaaatacccgcttctcccacatcattcatcacttgtaaattggcacttgcaatatccttaccatccagttgataaaccactttaccaatcacttgaccttttactaatggtgcttgtaaatttttatctgctaattcataacgagctttaacctcactttgtttacctttagggatcgtaataaagtgatccattaaagcaccaagttttactgaatttttatcgccataataaaccctttgttctgaaatttctttaccagcctctaaagttttaaatgtttcgaaattagcaaaaccccattgtaaaagtttcttactttctacttcacgacctttgtaagttggcacacccattactacagaaattaaacgcatattgtttgatgtagtcgctgaagcgactaagttatatcctgcttggctagtatgccctgtcttcattccatcaacattgatagttttatcccataatagtccattacggttagcttgtttgattttattaaatgtaaagtttttttcggagtaaattttatattcttcaggtaaatcacgaataatatgcgcaccaataattgccatatcacgcgcggaagaatattgatttggatcgtctaaaccatggggcgtggtgaaatttgtatttttcaaaccaaattgttgaacatatttattcattgtttctacaaagttcggtacattgccagaaatatgttcagctaatgcaacagtcgcatcattaccagaaacaacaatcacacctcgatttaagtctgctacagatacttgtgtatttaaatctaaaaacatttttgatgaatcagggaaattacgcccccacgcactttcaccaatggtaaccatatcggtattatggattttgccttgttttaatgcgacaccaactacataacttgtcatcattttagtcagtgatgctggatattgacgttgatctggattaagtgcggtcaaaattgcacctgaattataatccatcaatacatacgtttgagccgtaatttgtggtggagttacgccaaactgcatatcctctgcagataccgaaaaagcactaagtgccacaaaacttgataaaaatgcgatttttgttgttcttttcaacatagtgtgttcctacaattaatttttatacgtataaacaattaatggcttattatttgccattttttgtaatttagttctcacttgtgccatttttgttttgtcatcaaaaggcccaatataaatttcatatttatttcctgagcgatttacttcagtctgaatattcgctaacgcaagttgcgtaattaatttatttgcttggctacgagaggttaattcaagcattttcaaacagtaaaattcggttccttttagagcatttattgacttagatgtgttatcaaaaagtgtgttagattttaatactaaacgatcggcagcttcctgagtttttgcttgtttagccagtgtttttgtggctgcgcctgataaattcccatttttagcaacgtgcaacgcctcaattcttacctgccctatgccgcgggaaattaagccaatttcttttgccgcagcgtgtgaaagatcaattaaacgtttatcactaaaaggcccacgatcattaatacgtacgataactttacgattgttatgtaaatttgtcactaaagcataagaatttattggcaatgttttatgtgctgcagtaaattgttttgagttataaacatcgccacttgctgttttgcgcccatcaaatttaagatgataataacttgctaaaccttctttaatataagatttggcttcattcccacttttagtggtataagtttgcccttttactgaataagtccttggtgcaggcatttgagttgcgatagaaagattatcccctcgaataccatacattttttgcgtatcagcctgtgcaggaaaagctacgcttatcataaatagcaaaagtgcggtcaaatttaacccagtttttaatttcataaaatattaacgcttttcatttattctttctttaagaaagaaaaaatgaaattagctccttttcataaattgacttttatgcgtatgaatagacatcagtaaaccaaaacttgccataatcgcaacataagaggtaccaccataactaaataaaggtaatggcacacccacaacaggcaaaattccgcttaccattccaatattcacaaatacataaacaaagaaaattaatgttgttgcaccagcaagaatacgcccaaaagaagtttgagcatttacggcaatcattaaacctcgcacaataataaacaagtaaatcgccattaaaatcaaaaaaccaatcattccgtgctcttcacccattaccgcaaaaataaaatctgtatgaggttcgggcaaaaattctaattgtgattgagtcccctgcatccagccttttccgcttaatccaccagaaccaatcgcaatctttgattgtaaaatatgatagccagcaccgagaggatctttttctgggtccaataatgtgagaacgcgagtgcgttgataatcgtgcattagatataaccacatgatcggaataaatccagctaagccaatcactgccgctaaaataagccaccagctcattcctgctaaaaacacgacaaataaacctgacgcactgaccaaaattgatgtgcctaaatcaggctgaatcgccacaagcaatgttggcagtagaatcattgcaatcgctataaatgtttcacttaatttaggtggaagcgggcgattacctaaatacaccgccaccattaatggcacagcaagttttacaatttcagagggttgaaaacgaataaatccaagatcaagccaacgctgtgcacctttacttgtcgtaccaataacatctaccaagatcaataacacaaaaccaattaaataaagataaggtgcgatgcgttggtaaaatcttggtggaaattgagccattaacagcataacaataaatccaagtaagacctgaataattcggctattaaacatcgtttcgctggcacctgatgcactatataacaccagcataccataagcagttattgcaagaagtccgataaacagccaaaaatcaatatgcaaacgttgccaaacacgcaaccaaaaagggattttatcttccatttatttgttcgctctcttgtgacaaatcttttttttgctgaataggtacattatatttttcaacttgtggtaaacgctgatttaaatagtaatccatcactttacgtgctaagggtgcggcattacttgaaccaccacctgcattttctaaaatcactgttacaactaatttaggattatcataaggggcgtaagcggtaaaccaagcgtgatcatgcaattctttttttaagcctgccgtattatatttttcattttcctttaaactaaacacttgtgcagtgccagatttccctgcaacacgataatttgcatctgcaaaggcttttcgcccagttccatttgcagcattaacaacattgtacataccgcgtttcgctgcctcccaagctgccactttaggtgtattaatatcaggataaagtaacggatcttcataaggctctaatactgcaccttcaattgctttcatcaaatgcggtgtatttactttgccattattgaccaatattgtcgtcgcttttgctacttgtagtggtgttgccgtccaataaccttgaccaatcccaaccgaaatcgtatcgccttgcacccaagggcgtttataacgtttttgtttccattctcgagttggtatattggcagccgtttcttcttgaatttcaatccccgttggcataccaaaaccaaaatccttcatccaattagaaaggcgatcaatacccatattataagccacttgataaaaataagtatcagaggattcagtaatcgctttattcaaatccgtatccccgtggcctgtttttttccaatcacgaaaacgttttgtggaattaggtaatacccaatatcccggatcaaaaatcgttgtgtttggtgtaatcacattttcagtttgtgcggctactgcaataaaaggtttgactgtcgaagcgggcggatacgcaccttgtgtcgcacgactataaagtggacgagcaagatcatttaataaacgtttataatcttcggaggaaataccatcaacaaataaattattatcataacttggtgtagataccatcgctaatacactactatctttcggatcaagcacaactacagcaccttttagtcccgataaaagttcagtaatataacgctgtaatgccaaatcaatggttaaatgaatactttttcccgccacagcaggtcggctacgcaaagtgcggattactttgccgcgattattaatttctacttcttcaaaacccgtggtaccttgcagtatatcctcgtaataacgttcaatacccaattttccaatatcgttcgttcccgcataattcgcgaatttatcctctcgtttcaaacgttctacatctttatcattcattttacctacatagcccaaaatatgcgccattgtttcgccatataaataatggcgtttgaaataaggacgtacctctaagctcgggtattggtagccatttaccgcaaagcgtgaaatttgttcttctgttaaattcggctttaataaaatcggtgtataacgcgttccgcggcgacgttcctttttaaaattttcaatatcgttatccgtcaatcccacaatatagcgtaattcatctaaagtgcggtctaaattttcagttttttctggcacaatgtataaaccaaaaaaagtaagattttcggctaataatttgccgtaacgatcatagattaagccacgtgttggcggtaaaggtaataatttaattcggttaccattagaacgcgtttggtaagtatcgaaattaacaatctgtagctgataaatattggtgaataacacgcctgttaagagcagaatccccaaaaaagccactaacgttcggcgtgcaaaaaggttacgctccgcttttttatcgcggaacggttcgtgcgttggtgtattgaagaatttttttaaattcatctgactaaaataaggatgtattattctcgatgataaggatgattagtggttagcgaccacgcacgatacaaactttcagccaccacgacacgaacaagcgggtgaggtaatgtcaagggagaaagcgaccaactttgctctgcagcagctttgcattctggcgaaagcccctcaggcccaccaatcaataaacaaacatcgcgaccatcatttttccacgcttctagttgctcagctagctgcggcgtcgtccaaggtttaccaggaatatctaacgtcacgactttgccttttccacaggccgctaacatcgctttaccttcttgttctaaaatgcgtttaatatcagcattttttccacgcttgcctgctgggatttcaattagttcaaaaggcatatcttttgggaaacggcgttgatattcctcaaaacccgttgtaacccaagaaggcatttttgttccgacggcaattaacgtgattttcacaagtcatccttatctaaaaagtgcggttattttttaccgcactttactaaaatttacgcccaaagtttctctaattgatacatttcacgggcgtcacgttgcatgatatgtacgatagcttgaccaagatccaccacaatccaatctgcagtatttttaccttcttcgccaaaggtttcaaaacctgcttttttacattctgtaattaaattatctgccattgcagaaacttggcgactcgacgtccccgtgcaaataatcatattatccgtaatcgaggattttccacgtacatcaaaatgtacaatatctgttccctttaacccatctaaggtttccatcaaaaattcaactaacgccattttgttctcacttagcaataaaggtgcggaattctatcattgaataccctcttgcgcaaaatccacgcaaaaaataagcgcgaaattaaccgcgctttttatgtctaaattgaaattatttttactatgctgcccataataacactgccaataactgtggcgacattattcgcaagaacatcaccaatggatacacagttgcataagaaagtgctgcagcaccgttatcttctttaatttcattcgcaaatgctaaagcgggaggwtccgtcattgaacctgcaagtaaaccgcatattgtgaggtaattaagttttccatataagcgtgctatagtcccaacaataatcaacggcacaaaagtgataaaaataccgtatcccatccattcaagtcccgaaccattcactaaagtatcaaagaaacttccacctgattttaaaccaacaaccgccaagaaaaggacaatcccaatttcgcgcaatgccaagttagcacttggtggcataaaccagtaaagtttaccaatcgtgccaattctcgctaaaatcaacgcaaccaccaatggcccgccagcaagccctaattttaacgcaacagggaaacctggaatatagaatggaatcgaaccaacgagtacccctaaaccaataccgataaacactggtaacatttgcacttgaagtaatttctgttgtgcgttaccaataactgaaatggcctgatttagtacatcactgcgtccaaccatatgtagcacatcgccaaattgcagtgtggtatttcccgttggaactaactcaatccctgcacgatttaaacgtgaaattacaaccccatatttttgatgaatgcctaacgcacggatctttttgcctaatantttttcantcgttaccaccacacgctcggaacgaatttcgccactataggcaacggttggtgcatcaacttcgtgtccgataattaaacgcantttagcaagcgaattatcatcacccactaattgtaaaatatcgttggtacgaatctcagtacttgcctttggaacaatttccatatcatcgcgttttaaacgtgaacatacgacttcttcatcgctaaatcccggaatttgaattaacgtcagaccatctagattttggttcgtcacttttaaagaaatattatgtaaactttctttatcttggctgctctccgcattaaaacgagcagcttcatcgtccactttgacgttaaaaaacaagcggattaaccacattgcaagcaaaataccgcaaatcccgaatggataagccattgcataagacacccccatagttacagtggtttgaggcacccctaattctgctaaaatttgctgccctgcccccaacgcaggcgtattagtaacagcaccagaataaatacctaaggcaatatccagtggaacatccgcaattttatgtacaagaaccacggcaattgaccccagcagaataatcaaaatggcaaaggcatttagctttaaaccagattttcgtaaagaagaaaaaaagccaggtccaacctgaataccaatagtataaacaaataaaatcaaaccaaattcttgcacaaaatgcagcgtatgcgcatccagtttcaagccatattgattagtgaaatgggcaacaataatgccgccaaacagcacgccaccaatgccaagcccaaccccgcggatcttccaatgcccgatccataagccgattacggcgacgagggcaagaagactaatcgtgatcgcaatatcactcatattgaccccttaaaaatgaaatttaactccttcggattatatccaagttgttttttgaaaaccttaaccaaactcaaaaaatgatacgttcgtcacattttttcttgcgaaattgagcatagcctctacaataccgaaaatttttgacccttttacaaaaagtgcggttatttttcaccgcacttttatctcggatggaatatttatggattacagccaagaagctattacttctcttatttggattttacaaacgctagccatcacctcagtcgtctttagttttggcatttttcttttggtgcgttttacccaatggggaaaacaattttggatgtttgcaggcggttatctttcacctaaacgtagcattaaacctatcttattctttctgcttattgttgcaatgacattacttagcgtacgtatcagccttgtaaattctgagtggtataaaaatatgtatacctcattgcaagaatttaatgaacatgtattttggcaacaaatgggcttattctgcgtcatcgcagcaagttctgtttcagcagcattagtaagctattatttagagcaacgtttcgtcatcaactggattgaatggcttaacgagcagcttgttaataaatggatggcacatcgcgcctattacaaaacacagtatttatcagaaaatcttgataaccccgatcaacgtattcaacaagatgtgcaatcttatgtaaaaaccacgctttctttaagcactggcgtcattgatgcggtcacctcgatgatctcttacacgattttgttatggggattagccggtccaatgatagtgcttggtgtagaaattccgcatatgatggtatttttagtgtttggttatgtcattttcacaaccctcatcgcattctggctcggtcgcccattaatctcattgaattttattaatgaacgcctaaacgcaaactatcgttattctttaattcgcattaaagaatatgctgaaagcattgctttttatgcaggcgaaaaagtcgaaaaaaatcagctttatcagcagttcaacgccgtcattcacaatatgtgggtcattatatttagaacactaaaattttcaggatttaacctagtcgtaagccaaatttctgttgtttttccattgttaattcaagttggacgttactttgaaaagcaaataaaactaggcgatctaatgcaaaccttgcaagtatttggtcagttacacgcaaatctttcattcttccgcagtacttatgataattttgcaagctataaagcaacgctagatcgtttaactgggttctgttatgccattgaaaaagcaaataataaatcacaaacacagatccacaatcatccaacagatgtgattttcaaaaatttaagtattcaaaatccattaggtcatacactaattaaacatctaaacattaccttaccgcaaggaacaagtttgcttattcaaggaaaatctggagcaggaaaaaccacgcttttacgcaccattgcggggctttggagctatgccgagggggaaataaattgccctacgcacaatcagcttttcttgtcacaaaagccgtatgtgccacaaggaaatttaatgtcagcattagcttatccaaataacgctgacaatatttcacatacacaagctgtagaaatattaaataaagtacaactaggacatttggctgaacaattagaaaaagaacaagactggacgcgtattctttctcttggcgaacaacagcgtttggcgtttgcacgattaattctacacaaaccagcggtggcatttttagatgaagccacagctagtatggatgaaggtttagaattttcgatgtatcaattgttacaacaagaactaccacaaacgacaatcatcagtgtgggacaccgttcaacccttaaaaccttacatcaacaacagttaattctgcaagacaaagggcaatggcaagtgctataaaaaacgctaaaaaacactgtaatcgcaacgctttttttgatacatttagtgcaattttttgtatgtttgacaaagtcattttctactttttgtcaaacaaaactaactttcattttaaacggtataattatgttatttaaaaaaattcgtgggttgttttcaaacgatctttctattgatttaggcacagctaatactttaatttatgtcaaaagacagggtattgtacttgatgaaccctctgttgttgcgattcgtcaagatcgcgtaggcacattaaaaagcattgcagctgtgggtaaagaagctaaattaatgttaggtcgtactcccaaaagtattgtagcaattcgtccgatgaaagatggcgttattgcagacttttttgtgacagaaaaaatgttgcaatactttatcaaacaagttcatagcggtaattttatgcgtccaagcccacgtgtattagtatgtgtgccagctggtgcaacacaagtagaacgccgcgcaattaaagaatcagcaatcggtgctggtgcacgtgaagtatatttaattgaagaaccaatggcagctgcaattggggctaaattacccgtttctactgcagttggttctatggtaattgatatcggtggcggtacgacagaagtggctgtaatttccttaaatggtatcgtatattcttcttccgtgcgtatcggtggtgaccgtttcgacgaggcgattatttcttatgttcgccgcacttttggctcggttatcggagaacctaccgccgaacgcatcaaacaagaaattggttctgcttatattcaagaaggtgacgaaattaaagaaatggaagtacacggacataatttagccgaaggtgcgccacgttcatttactttaacatcacgtgatgtcctagaagccattcaacaaccattaaacggtattgtagcagcggttcgaacggcacttgaagaatgccaaccagaacacgcagcagacattttcgaacgtggtatggtattaactggtggcggtgctttattacgtaatattgatattttactttctaaagaatctggtgtccctgttatcatcgcagaagatccattaacctgtgttgctcgtggtggtggcgaagcattagaaatgatcgatatgcacggcggcgatatttttagtgatgaaatttaatcagaatatgaacaaaaagtgcggttaaaaataaccgcacttttcctttcacttttttcattcaacaagagaaagtttaatgaaacccattttcggcaaagcccctcccctaggtattcgtctgcttatcgctatctttgcatctattgccttaattttagctgatggacgtaatagctcaataacgaaagcacgtagnnnaatggaaacggcaataggcggtttatattatcttgcaaatagccctagaagtatcttagatggcatttcagaaaatcttgttgataccaataaattacaaattgaaaacaaagtactacgccaacagcttttggaaaaaaatgcagatttacttttacttgatcaactcaaagtcgaaaatcagcgattacgtcttttattaaattctccgttaagaaccgatgaatacaaaaaaattgccgaagttcttactgcagaaacagatatttatcgccaacaaattgttattaatcaaggcaaaaaagacggtgcttatgtaggtcagcctgtcattgatgaaaaaggcgtcattggacaaattatttccgtgggcgaaaatactagccgagtactgctactcacagacgtaacacactcaattccagtgcaagttctacgcaatgatgttcgtgttattgcgagtgggactgggcataccgatgaactaagcctcgataacgtgcctcgttccgttgatatagaaaaaggcgatcttctcgtaacctctgggcttggtggacgttttcttgaaggctatcccgtagctgttgtacaaagcgtttcacgtgatagctctaattactttgcaatagttaaagctaaacctttagctttattagaacgtttacgttatgtacttttactttggccaagtaacctagatatatcaaaagtaaaatcaatatcgccagaagaagttcgcaatctggtgcaaaaacgtttagaaagccaagctaatgaagcaaattatagagtgaaaaaaacacccttaacagaaaaagactttctagaaaatgaagaaaaaaccattattgaaccagatattccaacagattttcttcaaaatgaagaagatcttcccatagaacagcaagaagaaaggatagaagactaatgcaaacacgatttattttacaatggttcactattttaagcttctttgttattgcctttgtattagaacttgcaccttggccagttggtttccaaatgctaaagcctgcgtggcttgtacttgtattactttattgggtattagctattcccaataaagtaagtataggctggtcatttttactcggattaacttgggatttaatattaggctctacattaggcgttcacgctcttgtactttctacgagcatgtacatcattgccaaaaactatttaattctgcgaaatttatcactttggttccaaagtttattggttgtacttttcgtcttcattataagattacttattttcttagttgaattttcactccatactgccttttttcattggcaagccatcttgggcgcattcgcttctggtttactatggccgtgggtatttttattaatgcgcaaaatacgcagaaaagttaaattacattaaaaaagagagataactctctcttttttatgatttatgaatgtttcaaacacctaattcaatggcttattgctatccagtaaagaatcacattcccaaccgatatactctcccgaaaattgttcagccaatttttcaaaacgttctacttgttcaaaaatttcgctattttctaatgaaatttcttgctctaattttaccaagaaataaggttcgtcatcttcattaaactgaatcgcttgtgcagaatattgtaatgtcgtgaaagaataatcccctaaactaagctcatccataaaagggaacattttctgctcttcatcaaaatgaaaactatgctctactaaataggtatcacttaaattacgacctttactttttaataaatcaagcaattcttccgttgcatttaacttaatctccaatggagaagcgagcaaaaagtcaaaataagtatcccaaattaaatccttttgcacattaatatctttaacaaaatcaatttgttgtaaagtttctacaataagattttcatgcttacaataaaaatgtatttttatttgagaattacaaataaaatgccccgcaaaaaatacatttggaagtgcggttagttgtgtcaaaattttaaatacacggttaattaacttatcgtattcaacttctgagggtaaacccgtttcatcatcagcctgataatcaatagtaaactgcactattttatcgagacctttaccgtgatatttttcaacatcttcaatatttgcggtaaacacggcaggcataccattcacagtagaacgataattctgccaatttgccatatccatttcgctttcctatttaaattcagcccaaatcggtgcgtgatcagacggtttttccattgctcgaatatctaatgcaatgcccacatcgacacatcgttcagctaatttttggcttaccaaaatatgatcaattcgtaaacctcgattatcatcaaaacctttagaacggtaatcaaaccacgagaatttatcatttgctgttgggttcagcttacgaaaactgtcttctaatccgtaatcatacaaacgttgataccacgctcgttcttccggtaagaaagaacatttccctgtgcgtaaccaacgtttacgattttcatctccgataccaatatctaaatcacttgggctaatattcatatcgcccataattaaaatcggattcgatttgtcgtgttctttttctaaatactgttgaagatctgcataaaatttctctttagctggaaatttagtctcgtgcgcacggctttccccctgtgggaaatagccattaatgacagtcaataagccaaattcagtttccagatcagccataataatgcgtttttgtgcatcttcattgtcagttggaaaaccacgacgaatcactttaggttcttgtttagtcaataatgccacgccataatgacctttctgaccgtgatgaaatacgtgataacctaagttttctgtaatttcatagggaaaagcctcgtcagcaactttaatttcctgtaagccaatcacatctggctgatatttttcaataatggcttcaagttgatgtgggcgagcacgtaacccatttatattgaaagaaataaatttcatttttgttcctattaaagagtgaaattggctttattatacagagatttctattttgataaaaacggctttgtcagataaacctgaatttgctcaaatactgtaggcttaatccaaaattgaccttgagaaggtaaacaagtgaccgaaataaaattatttagataatcaaattccaattgagtagcgtgcaaataagtgcggtcaattttttctgtgtttttaccataaagcccatcgcctaaaatcgggctacctaaacttttcatcgcaacacgtaattgatgcgttttccccgtttgtggttttaaaataaataaacgtaaattaggctcacaacttacactttcaaaacgcgtaattgcgggattgtcttttgtttggcaaagtttccatgcgccttctcgagctttcttcatatccccgataatcaaaccttgtttctttttaggcttttggttacttaatgccaaataagttttatgaattttatgttcagaaaaaagtcgtgaaaattcagccgcactttcagcatttaacgccaganttaacaaacccgaagttactttatctaagcgatgaaccaaccatactttaggcacattcagttgttttgcaacaagttctgttaagccttgttcttcttgatctttatgaacgctaataccctcagacttgttgataataataaaatcgctatgttgataaacaacctcgatttccatcagatttgctcctttttgtaaattttatttttaccgagaacaatatcttttaccgaactaagtaattcctgttgaatatgtgacagttttggtttttcgtttaattgaaatgctaacggacgacaaagttccattgctttcacgcctaatctagcagtgagtaatcccacaccaattccttgagcgatacgtgtagataattttgctgtcacatcttgagaaagccaatccattccaatatcttgtgccacttcggttgctccagcaaaagcgatattgaccaataccattcttaacaatctaatacgtgnaaaataccctaattcaatcccataaatttcagcaatcttattcattaatcgaagattgcgccacgcaatnaaaaacatatccactacagcaagtggactaatcgcgacaatcacagctgattcagctgccattttactaatcaattttttagcttgtgcatcaaaagaagacaaaacatgacgactgaataaatgagcaatttcttgcgccgaataagcttcatttaattggtgttgccattgaattaccgttggagaatcattttccaaacctaaagattttgcaatatctaagcaaagaattttacttttttctgcgttatgaacggaaaaaacatcaccattttttaccgcactttctaaccaaatctgctgactttgttgttgccattgctcacgtttttttaaacgaactaaacgtcgccactcacaaataatctctttaatacccaataaaatgataatcaaactgactaaagcaaaagcaagataaatccattgatgtttttgatagctatcccaaatccactgcacggattgcgcaaccgtcgccaagccaaataaaagtgcagtaaattttaataaagtttttctaaaactggattttggtttcaatgcttgttcaagttgagcatcaagtaactctccgtccaacgcttcatctagctttgcttccatattatggaantcttgcttgggctgatagtgttcttcctctacattaactgaatgttcaaaaatttgtttttccattgcctatcccaaaaaataaccccactaaatagtggggttataaagtcaaaaatcaatcattattcatcacttgnaaagatagaaagtaatcttaataaactcaagaataaattgtagattgaaacatagatgttcacggttgcgcgaatgtaatttgtttctccaccgtgaataatattactggtttcatacaaaatggtcattgttgagaacactacaaataatgcactaattgcgaccgataaagcaggaatttggaagaagaaactcgccaccataccaagcaataacacaataaataatgcgaacattgcgcttgataagaatgacatatcttttttcgtagtcaatacataagcggaacacgcaaaaaatacgatagcagttcctgcgaatgcaagcataatcaaatcttccattccacgtgccacatacatatttaaaattggcccgatggtgtatcccataaatccagtgaaagcaaaggccgccaaaataccagcagggcgatcagctaatttattggttaagaaaagtaagccataaaaacccactagtaacacaataatatttggataaggcaagtttaagctcattgaaataaacgcaacaaccgctgaaaaagccattgttaatcccagtaaaaaatacgtgttacgcaacactttatgtgtgctgagtaacgattctttttgagcatccacaataagacgtgattgcataaaagctccttgtaaaataaataaaaagtcttctgtaaagtaagggctagggataaaaaagtcaatggtattaatggaattaatttcatcaaaatgaataaattatcatcatctaaagttaaatcatcaaatttctatttacatcaataaaatattcattatactacgcgcatcaatcacggaggaatggtcgagtggttgaaggcaccggtcttgaaaaccggcgagggtttacgccctcctagggttcgaatccctattcctccgccatcagaattaagaaatccctaagtcacaaggcttagggattttaactttgtattacgttatttggtcaatccattcactagtgaaataacagtctgaatatcgctatcagacaattttccttctttcacaaattttacttttcccgttttgtctaacacgataattgcactatctttagaatttaatccccaagcattttttaccgcacttttatcatctaacacaacttggctatgtggattttcctgtttgccttttttcgcaccattttttacaaacatacctgtaccaacaatcgcatcatccgcattaataatagtggttgtttggtattttacaggattaaaatgggatgcttttatcacatcaatcatcgactgattttnctcttttgcagccgttctacccgctaaatgatgaacaacacgcactttacccgctaattccgcagaaccccaaggttgaaacacagtatcttttccagaaagcacaatttcaccatactcactcactttgaccgatggtaaagattgttctaattgcaaattgtgtgcccaagttgaactactaaatatcacgccacaaactaaggcaagaatttgttttttcatacattttcctcaaaaatttatcaaaaactttcacgctttggcgaaagacatctttttgctatactcgtgcgcctattatatgtaatcaagaaggaaaacccaatggatcaaatgcctaattgcccaaaatgtcaaagtgaatacgtttaccacgattcaattaattttgtttgccctgattgcggtaatgaatgggataataatgaaattcaagaatcagatgacgatcaactaatcgtaaaagacagcaatgggaatttgcttgcagaaggcgacaatgtacttttgattaaagatttaaaattaaaaggttcatcagaagtattgaaaaaaggtacaaaattcaaaaacatccgcttagtaaatggcgatcataatgtcgattgcggcaaaatcatgttgaaatctgagtttttgaaaaaggcttaatcgaaaaaacgcggtctaaatagaccgcactttgcactttaaagaaataaatttatttaataatatcaatcacttctctgactaatcgtccaatttcatcccaattattggattgaatcaattttttctccacaaaccaagagcctccacaagcaacaatattaggaatagcaagataatcccttatgttatgaagccctataccaccagtcggcattatctgtaattgagcataaggaccaagcaatgctttaatcattttcactccgcctgaagcctctgcagggaaaaattttaccgccgaaattcccatttctaatgcaatttcaattgccataggattattcacccctggtgttattggaaaattcaaatcttgacataatttcacaatttttggatttaacccaggagtaaccacaaaatctgctccgctacttttagctaaaactacttgttccgcagttaaaactgtgcccgcagcaattaaaaagtcaggtctatttgcacgcaacaaacggatcgcatctgccgctgcttcagagcgaaaagtaatctctgccacagataaaccatttttagccaacgtatctgctagcggcaaaatatcgtctgcattatccaacgcaattacaggcacaattttgagttcacgaagtttttcaataatttgttgagttgtgtatgacatttttttaatttgctcctattagactccactatacgcagaaaaaccgccatcaacaggtaaaaccacgccattgacaaaagcagaataattttcatctattaagaaaagtaatgcaccgagcaattcttctgactcaccaaaacgtcccattggtgtgttagtgaggattttatttgctctatctgttggttttccttcagtatcaaataataaagcgaggttttgattactaactaaaaatcctggtgcgatagcattacaacgaataccaactttcgagaaatatacagcaagccattgagtaaaattactgattgcagcttttgcaccagagtaagcaggaatctttgtgagtggcgtaaaggcattcatactggaaatattaataatatttgccccttgtttaccaagcatatcttttgcaaaaacttgggttggtaataatgaacctaagtaattgagattaaatacaaattctataccagatttatctaaatcaaagaatgttcttgtcgtttcatttaaatcaaattgatggaactcattatctgttgtcgcttttggattattcccaccagcaccattaattaaaatatcacaagtgccaaaatcggtttcaatttgatttctcacttctttaatattttcaagttctaacacattagttttataggcttttgcttttcctcctgattggttaatttcctttgctactttgtctgcagcctcgaaattcaaatctaacaaggcaatattagctttagtatacgctaattgcttagcgagaaatgaacataacactccgccagcccccgtgattataattagtttattttctaagttatggtttgctgcaatattcatagtaaactccattaattaaattcagattgaagatgagaaattgcgactttatctataatcgcacctttatgttgaatgacgataccagcaatacgattgccttgctgacaacaaatttcgagagatttatttcgtaaataaccgttcagaaatccagcattaaaagaatcaccagccgaggttgtatccactacatttaaaataggttcaggtatcacttgcccatattgagataaatacctatctgaaaaaatagcaccattcttaccgcacttcacaatcacttttggtataccaattttatgtaatcgctctaaagtatccctagatgttttatctttccataatgcttgttcatcatcaaaagtcaccaacgctatattgacactaggcaaaagctgcaaataacaatcttgtgcttcttctaatgaatcccaaagttttgggcgataattactatcaaaaacaatttctgtgccttttttagctaaagaagataattgttcaattaaaaaagtgcggtcatttttaggtaagattgctaatgaaataccacttaaataaatcacatcaacttgctgaagttctgcaataaccttagcaaaatccggatgttgaaccatataacgtgctgcagattgattacgccaataaaggaacgtgcgttcgccttgagcatctaattggattagataaagacctggttggtgctgttcatcctgtaaaacccaatttgtttggatgccatcagcttgccaatatttaagcatttgcttgcttaaattatcggttcctaatgcagagacataatgaacttgaatctcttttgatgaacttactcgactaagataagttgcagaatttaaggtatctccaccataactttgccacatttccgcaaagggtttcccattgagttcaatcatacactcgccgataaatgctatttttttcatgatgtaacttcctaataaatcaagataaccaattcattggaacaattacaatttcaggaaaaaatacgatcaacatcataataattgcgtacacaaataagaatggagcaattcctttggataatgctcctatccctaattttgatatccctgagcctacatacaaaactgttcccacaggcggtgttattaatcctatagataaattaatcaccatcatgattccaaaatacgcaatatcaatattatatgctcttaacactggtaataagactggaacaaagattaataccgcaggaattaaatccattacacatccaacaagtaataaaaatagcattataataaacattaaaattgtcggactatcagttaatcctttaatcgtttggactaattctgttggaatttgagcaactgtaatcgcaaaagcagatatcattgctgatgcagcaacaaacattaccattgatgttgttttgatggtaccaatgaagacgtcttttaatttagaaaatgttaagcctttataagcaatacttactatgccagcataaattgcagcaacaactcccgcttctgttggagtaaaaatccctcctcttaatcccacaataataatgataggtaataataaaggccaaaatgcttttttaaaagcaacccatctttctttgccagtttgttttctttctagacttgtatcattatttctatacaaaattttccaagtaacccataatccaacgaccattaataagcctggtacagttccccccataaataatttagtgatggatgctccagcagtaataccgtaaatgatcataggaatgcttggaggaataacaactgaaataatacctgcagcacaaattaatcctgtggaacgagcaccatcatattttttagaaatcatcataggaattagtattgcacctaacgcggccgtatccgctaccgcagaaccagataaccctgcaaatatcaacccagaaatgatcgcaacataacctaaaccacctttaatatgaccaaccatacttgttgcaaaattaatgattcgctcagaaattccaccatgcttcattatttctccagtaagcataaagaaaggaatagccatcaaaggnaaattattcgttcccatcacaaagttttctgtaattaattgcgtatcaaacatatcaagatgatatagcataatactcgcactcaacagcattgatagtgctacaggtacaccaagaaataacaataagaataaactacacaaaataatagtaacattataagctcctatttatcagaggattctttatagtctttaatcatgctaaacatgacaataaaaaagtaagatacggcagatataacagcagctaaatataaaaaagatgnagatatacctgtagctggcatttgttgagtataggtcaaagacatcagttgtaatgcaccataagctataaaaatcattgcaatcagaacgcatatatttgcaactattaagactatttttctatactgctcaggcaacgcaggaataataatatcaacagtaagatgagctttatccttggcnacaagtataatcccaaagnaaatcatatatacaaaacaaatcctagaaaactcttcagaaaatgcaattccagaatcaaagaagtacctcaagacagaattaaaaaacacgagagaaatcataataactaatgccaagatagaaagatattctaatgctttgtctaaatactttgctattttcataaaacaagctccttctttatcccccatgagcaatttataaaattgaacataggggatcttattaattatttagcttcgttaattttttggactacatccttagcccaatcatattttttataaaaactatcataaagcaccttagatgcattcaccatgtcatttttaaatgcttcacttggtacgataatttcatttccatgtttagctagataatctttaacttctaattctgttttaattgctaattcccactctttctcttgatacaatttagctgctttttcaaaaataatttgatcttcttttggaattttattccaagtttttaagctaatttgtaataatcctggagagaaaatatggttactttggataatatatttttgtacttcatataacccagagtctttaattaacatatacggattttcttgaccatcaattaccttttgttctaatgcagtaaaaacttcactgagcggcatgctttgtggatttatattcattgctttagcccaatcaacaaaaagtgaattcagcggaactcttaaacgtaaacctttaaaatcgtcaaatttctctaattttttattagatgaaataacacgaaatccattcataccataggcaagtaatttaattccatacttctccattttttgaccaattttatttgcgattggagattccaatacttttttagcctcttgattatccttaaataaataaggccattcccaaactccaaaaataggatctacattttgcaataataaacctgtaatacctgcttctatagtgccattacgtaatccatttacaatttgatcttcaccgccaagttgattattaggataaagtctaatctcatatttatgatttgtttcattttcaattgttttcttaaaatattcctgtaatgcaatatgtgatggatgaatatcagaattataatgtcctaacttaataattgtttttgcaaatgcactgctactaaacaatatacttgaagcaagtaataatttacctaagcctttaattgatttcataactttctccttattgattatgttttttagaaaactgcattaatttttaaataattttctggatgatcagataaatcagaaataaaactaggaatttcttcaaatttgatacacttagtaatgatatgagatgcattaattttattagtagcaagcatatccaatgcctcctcaaattcccccttgcttgttctagaaccataaatattcaattctttaaaggtaattaaatttgttggtaatggagtttctgtttttggccatcctgttaaagcaattcttcctgcaaaggaggcataatgcagagtatttttgatagaaatattagcaccagatgcctccataacaacttcagccatacgaccacttgtaatttccttaattcttttaatgtcatcctccttatgcggatttacaatatgttcaattcccaaggattttgcatactcaagacgttgttctaatatatcaactaaaattgggattgctccatattgaaccgctgctaatgcagccattaatccaattgcaccagctccaataattactatgtgttcccctgattttaaagttgttctatgtaaagcgtgtaaagctattgttaaaggttcagctaaaggtaattgatgaatcggtaggttatctgggactttagttaaaagatgagcgggatgtctaattacctcttgcatacctccatcaatatgaacaccaattacctttaatgattcacaacaattggttctaccaattgaacaaggatagcattgaccacaacaaacataaggatcaacaattactcggtctccaacccttaccccatctgacataccaattccactttcaattactctccctacaatttcatgcccaagtattcttggataagttactaatggattagttcctctatatgcaccaatatcagaaccacaaatccccattgattctacctgaataagtacatcattatcacttttctcgggataaggcacttctttaacaactacattgtttggtttttctaaacatattgctttgattcgctccttcatttttagactccttatatgccattgacagaataaaattacttgttatgtttaactatgatatgattatgaaacataaaaactctttttggaataccaaatatctatttttgtgagccatatcacaaaaataaaaaattggaataccaatttaaggaaaaatatggaaaatatagtaaatagaacatatacccgaataggtcaattgctaaaacaagatatttctcaaggaatttatagcattggagacaaactccctacagaacgagaaatttctgaaaaatttggtgtaagtagaactattgttagagaagcaatggttatgttagaagtagaaaagttagtagaggtaaaaaaagggtcaggcgtttatgtagtaagaacccccgaatcaatacatatggaacattcagatttaccagatgtaggtccatttgaacttttacaagctagacaactattagaaagtagtattgctgaattcgcagcgttacaagcgactaaaaaagatattttaaatttaaaacaaatactgaatcgagagaaagaattacttactcagaatcaagatgactatagtgcagacaaagattttcatttggcacttgcagaaattacacaaaatgatgtgttagtcaaattacaagaacaattgtggcaatatcgctttaatagtgcgatgtgggcacaattacattctcgtattttacaaaatgattatcatcatttatggatagaagatcatcaaacaattttatctgctattcaaaagaaaaatgctaatgaagctagaaaagctatgtggcaacacttagaaaatgtaaaagtaaaattatttgaattatctgatgtagaagatccacattttgatggatacctattcaatacaaatccagttgttgtaggtatctaaatacttgtaataacataggagttaaaaatggaacaagcatggcgttggtatggaccaaaagatcctgtttctttatctgatattcgtcaagcaggcgcaactggtatagtcactgcacttcaccatattcctaacggtgaaatatggggtattgaagaaattaaaaaacgcaaaactgaaatagaaaatgctggtttaagctggtcagtagtggaaagtgtaccagttcatgaagagattaaaactcagactggaaattatcaaaaatggattaataactacaaacaaactcttcgcaatcttgctcaatgtggaattgacactgtttgctacaattttatgccagttttagactggactcgaaccgatcttgcttatganttaccagatggttctaaagcattgcgctttgatcatatcgcttttgccgcatttgaacttcatattttaaaacgtcctgatgcagaaaaaacctataatcaagaagaacaagttgcagcaagaacctattatgacaatatgtcagagcaagatatagcgcaattaacgcgtaatattattgcgggcttacccggtgcagaagaaggttacactcttgatgaatttcaaactcaattagatcgctataaagatatttcatccgaaaaattccgtacgcatttggcttattttttaaatgagatcgtacctgttgcccaagaaataggaatcaaaatggcgattcatccagacgatcctccacgcccaatcttaggcttaccacgcatagtttcaactattgaagatatgcaatggtttgtagaaactcaaccattaccagcaaatggttttacaatgtgtacgggttcttatggcgtacgttccgataatgatctcgtaaaaatgactgaacaattcgctgatcgtatttacttcgctcatttacgttctactcaacgtgaaggtaatccactaaccttccatgaggcagctcatctagagggagacgtagatatgtttaatgtagtaaaagctttattaaatgaagaatatcgtcgattaaatcaaggagaaacgcgtttaatcccaatgcgcccagatcatgggcatcaaatattggatgacttacgtaaaaaaaccaaccctggctactctgctattggtcggttaaaaggtctagctgaatttcgcggtttagagatggcattaaaaaaagtgtatttcaataagtaaaagaaaaagtgcggtcataaaaaacattatttttatcgaccgcacttctaatttatttcatcaatcttctcattcgaatattgatcatctcgaccacaacagagaatcccattgcaaaatagatgtaacctttcgggatgtgaatatccaaactttctgcaattaaactaattccgactaaaaccaagaaagctaaagctagaattttcaacgttgggtgtgtatccacaaaatcgccgattggttttgccgcaaacatcatcacccccacggcaatcataatcgccaaaatcatcacaggaaggtggcttgccatacccaccgctgtaatgacagaatctaaagaaaatacaatatctagcacagcaatttgaattaatacgccaagataactcactttgtttttgctttcagattcatggtgttcttgatgatttatcgcctctttaatttcgccagaactttttataatcaggaataaaccaccgattaataaaatcaaatcacgcccagaaatttcttgattaaacacagtaaataacggtgcagtaagtttcattatccacgctagtgacattaaaagtaaaattcttgttagcattgccaaagcaagcccaagaatacgaccagactggcgttggcgttcaggtaaacgtccaactaggatgttaataaaawtaatattgtcgattcctaaaacgatctctaaagccgcaagtgtcacaagtgatatccacgcttcaggatctgcaatccattcaaacataatttttcctataattgagttaaataaatccgaaaatacagatcataatggctttatgacgaaaagcaatcgttatttatatttgagaaatgattgattagtcgtttttaagcgtttcaaaaatcctttcagcaagtttaggggaaatgcccggtacagaggctatttcatctaaggtcgcctttttcacaccttgtaaaccaccaagatatttcagtaaagcctgacgacgtttagctcccacaccttcaatggtttctaaaccactttgtgtaaaggctttttgacgttttttacggtgtccgcttattgcgtgattatggctttcatcacggatgtgttgaatcaaatgcaatgccaaactatcatcaggcaaatgaatttcgcggtcttgtttgctgatgatcagtacttcctgtcctgctcgacgatccacaccttttgccacgccaattaagtgcggtctatttttatcccattttacttgaagatgttggaatacattcagcgcacgatttaattgcccttttccaccatcaataaaaataatatcgggaattttatcttcttctaaatcacgctcataacgtttctgcaacacttgttccatcgcagcataatcatccccgccagtaatgccttcaatattaaaacgacgataatcagattttagtggaccttctttattaaaaacaacacaagatgctactgtttgatttcccatcgtgtggcttatatcgaaacattccatacgcttaattttaggaagatttaacagatcacacaacgcttgataacgctctgacattcgtgaagattgtttaagttgtacatttaaagccgctttagcattaacttgtgcgagctgtaagtatttacttttatcgccttttacgctttcttgaatcgtcacttttctgcccgcttgctcgctaagaagttgctcaagctccgatttttcagctaattgacgatccacaataatgctattcgggatacttcgtccttgatgaccttgtaaataaaattgccccacaaaagtttcggtaagttccgataaatccgtattggcggggacttttgggaaataactgcgattgcctagcacttttccttgacgaataaacatcacctgtacacaggctaacccgtgttggtaagcgatagacataatatccatatcatctaaacgttcattggatacaaattgtttttctataaccgaacgcacagcctgaatttgatcgcgataacgagcagcctgttcaaaatctaaatttctgcttgcctgctccattttaccgattaaataatctaacacctgttgatctttgccttgtaaaaataagcgagctaattcaacttgctgattatattcttcatcggaaacatatccctgtacacaaggtgcagaacaacgcccaatttgatactgcaaacaaggacgagagcggttggaataaacggaattttcacattggcgaacagggaaaagtttttgcaaaagcgataacgtttcacgcacggctcccgcgtgaggataaggcccaaaatattcacctgcaaattttttagaaccacgataagaagtaattctttggtggcgttctttggttaataaaataaatggataggatttatcatcacgcaataatacgttataacgaggctgataaagcttgataaaattatgctctagcagtaaagcttccgtttcagatgaagttagcgtggtgtcaatatgatgaattgacgccaccaacgcctctgtttttttactgctcagatttttacgaaaatagcttgaaagacgtttctttaaatcctttgctttcccaacataaataacctgatctttatcgtcatacatacgataaacaccaggttcgtgagagacatcagtgaggaattttttagcatcaaacattttaattcgccgctaaaattgcccgcactttttccaaatcttcggcggtatccacccccactgcaggcacttctttcgcaagttctacgtgaatacgttcgccgttatataacacacgaagctgctcaagtttttctagattttcaagttgagtcggtgcccattgcacatattgttttatgaaacccgcacgatatgcgtaaatgccaatatgacgtaagtaagcgtcagaaagctgtactttctgaacatcctgcaaattcataaactgatcacgatcataaggaataaccgaacgggaaaaatacagcacatagccatctttatctgttaatactttcactgcatttggattaaataattcctcagcatcgtgaatttttaccgcaaggcttgccatattgacattaaattttgctaaattatctgccacttgtcgcacgataacgggaggaatcaaaggctcatcgccttgaatattgacaatgatttcattgtcaggaatagctaatttttctacaacttctgctaaacgttctgtaccagaattatgattaaccgaagtcatacagacttcagcaccaaaacttttggcaacatcagccacattttcattatcggtggcaataatcactcggctcgccccagactgcagtgctttctcaaatacatgttgaatcattggcttacctttaatatcagcaagaggttttcctggcaaacgacttgatgcaaaacgagcggggataatcacggtaaatgacataatttattccttattctttaatatttcagctttatcggcaagcaatcaaaacaactggggattaatcctttcagccatttctgtattgctccacaagtttgtctattttggcccaaaagtgcggtaaattttcacgttgtttttcagcctcaataatctccgcatccacagggacataccaccaattatctttagcaaaagattggcattttacggcatctttttccgtcataaagagcggttgattttcagcaagtttttctaattgagacgcttcaaaatgttgatgatcttgaaatgcttgagtttgctttaactgaatccctaacttttctaacatagtaaaaaaacgctgtggattgccaatccctgcgatggcaacaccagattgaaattcatttaattggcgtttttcattggtttttaaattaatcgcgaaatgaggcacaagacgcataactgcatctgaatactgattttttccaccattagtgatcacaaaatcgacagattttaatcgacttggtaattcacgcaatggacctgctggcaatacaaaaccatttcccaatgcgcgctcagcgtccattacgacaatttctaaatcacgttgtaattgataatgctgcaaaccatcatcagaaataataatatcgcactctgcttggcttaagagtaattcaatcgcttgctggcgattcggggaaatcacaactggcgcattagtacgtttagcgatcaatacaggctcatcgccaccttcaattggatttgtatttttagtgacgaataacggataagttttagatttactgccgtaaccacgagaaatcacacctacacgcagacctcgtttttttaattcttccataagccaaacaaccacaggcgttttgccatttccacccacagacaaatttcccacaattatcactggttttggtgcgcgataagaagacttcagccccaaagagaataaggcgcgacgaagttggctaatcaaccaaaacaataaagaaaaaggcgataagagccaaataagtttggagttggaataccagaagggcatagaaaatcctttctaataagtgcggataaaataacgcgagtttttcaactcgcgttttcgataatcaataaattagccagtaaactgcatactatgcaactgtttataggcaccattttgttcaagcaatgttttatggttgccacgctcacgaatttctccgtgatcaatcacaagaatttcatccgcgttttcaatagtagataatctatgggcaatcacaacaaccgtgcgatctttctttaattcctctaatgcagattggattgctcgttctgattccgtatctagtgcagatgtagcttcatctaaaattaatactggcgaattacgcaataaagcacgagcaatcgctaaacgctgacgttgcccacctgataggctagtgccattttcgccaattaccgtatcaaaaacttgcggtaatttttcgataaactctaaagcataagccgcttttgctgcagcgataatttcttcgcgagaatacttatcttgtgctgcataagcaatattattcgcaatagtatcgttaaataaatggacttgttgagaaaccacagcgcagttttcacgtaaattagataaacgataatcttggatatttacgccatccagtaaaatttcgccttgctcaatatcgtaaaaacgtgtcactaaattagcaatggttgatttgcccgatccagaacgtcccactagagctacggtttttccagctggaacgctaaaagaaatattatttaatgcaagttcatcttttccttgatatgcaaaactcacatttttaaattctaactcgcctttcgcaggttctgctttataagccccgtcatctttttctggctctaaatctaaaatggcaaatagcgtttgacatgctgccattccactttgaaattgtgcattcaccgcagttaatgattttaacggacgcatcatagctaacattgaagaaaataccactgtaaatgagcctgcactcaaattatcttctgcaatcaatggagtggtagctaaatagagcaccgtagctaatgcgagagatgcaataacttgcaccacaggatcagaaatggaatttgctgtcaccattttcatgctttttcgacgcatatcattactaacatgattaaaatgcacttcttccacatgttgccctccgaaagaaagcacaactttatgaccttttaacatctgttctgtagcagacgtaagttcacccattgaatcttgtaagttcttacttaatctacgaaaaatttttgataccaaacgaattaaaacagcaatgattggacctataataaaaagcacaattgttaattcccaactggtataaaacatcactgcgaatagcgaaataatatatgctccttctcgcacaattgtaatcaaagatcctgaagaagaacttgcaatcatttgggaatcataagtaatccgagaaagtaaacgccctgttgaattttgatcaaagaaactcactggcataaacattaaatgtttaaacaagcggcgacgcattgtcatgacaactttgcctgatacccacgccaagcaataattagaaataaagttggtaatgccgcgtaaaataatcatcccaacgacgacaaaagccatcattttcaaaaatgaatggtttgccttaccaaaaccatcgtccaacaacggttttaacaaataaatcaagcctgagtcagctaatgcattaaaaactaacgcgacgccagaaacaataagccccgctttaaaaggtttaatcattggccacaaacgcttaaacgtttgtaaggttgaaaaatcattttcttgtaatttttgctcttgcataatcgctatctaatagtaaaaattgcacgcattgtaccttttattcctttgataatccaattacacgcgcataccaaggggaaaattttgtgcgagcttgctggatttctaatcggtcttgaaaaaaatttacccgcacttgccccgaaacagcggtattttctaccgcacttttatagcgatgaagcctttccataaccgaataatgagggaatttccacggattccaacgcccactagaaataatcgctacatctggtctaacctgagaaagcaagtattcacttgtcgatgttttactcccatgatgccccacttgcaacacatcgattttgcctaaagtgcgggcaaaaatttgctcattttttgcttcagcatcgccagttagcaaaacgctattctttccatcatcgactaaaatcacacaagaatgggaattatcagctcgtgtcacaacgttgtgaggagaaagtatttgaaaatgcaacccttgccaatgccaatcacgcccagcagtacaaaaagtgcggtaattttccccatagtttttccgtgaaggggtaatcaattccacattgggatacgcctttaaaattgtcgaagcaccacctgcgtgatcgttatcgtcgtggcttaaaatcaatttttccaaaacaatcccttctctttgtaaataaggcaaaatttccaactcagccatacttccacctcgccaagaagaacccgtatcataaagaatccctttaccatttttcacaatcaacgtagctaacccctgccccacatctaaagtatctacctgccaagttggcttgctcaattgtttaaacaacaaaatcgtaaaacacagtaagataatgccgaaagaacatcgcaaaacgttgattcgttcattttttagcaaaggcttactgagatttaatgtaaaaaattttgctcgttttatttgccagtttgatgatgaaatctcgggttctcggtaaatattccaaataattaacataaaaattcctgcacaaagtgcggttaaacccaatgctaaattaaatgaaaccgtgagccaattcccttgaaaaacagaaattaacccagtaattccttcggctagcttgtttgctagttgccaagaaaacattgtgccgttagtaaaaacggcaaataaaattaatggcacaagcaaaaaactataaattggaaccgccataaaattggctaaaaatccactcaacgataagccattaaatagaaaaagttgcaaaggtgtaaaaaagagcaataacccaaattgcaaatgaaataaactaaaaatccaccgcacttttggagaaaaagggcgatttttccattgaaaaagtgaaaaaggcacataacgataccagaggagcaaacacccaaccgctccacaagaaagccaaaaactgaccgaaagcggcattaatggatcgcagaaaagcaagaatccgacaaccaacgtaaaaaactgaatgggcgaataatgtcgcctcattatttgaataaataaaacgaaaacaagtgctgaaatggcacgaaaagttggcacactaaaaccagccaaatacgcataaattaaagcaaataaaacaccaaaaactaaaggaaaataaggatgaataaaacgcgtaggaaagaacacttgcacaacacgcgccaagcaaaatccaattcccatagccaacccaatatgtaagccagaaatagcaataagatgtgcggtattggtttgttggtaaattgaccaagtggttttatctaaccaagcccgttcgccaaaagctaaggcaatcaataaaccttgtagagataatccttccgtttgcttctttacttgttgcaatttttctgcacgcaatgatgaaacatccgcaattttcaccgcactttttaccgttccaacagccgtaattccttttgaaaaataccattgttgccgatcaaacccaccgaaatttaatcgtgcagaaagggaacgtaaagaaatttcagcttgccaaatttccgataattgaggcacctctttcgctttccaatttaagaaaattcgttgttcttgcaaattattctccaatgttgctgtggcgataagcgtttgataatcctgttggtgcaaaatttcttgaatcttaaaagttaccacttgcttttgagcggtaatattttgagcttgttgtgataaactcaaagccgaataatgaaaatagccaagagaggcaacaaaaaaagcaaggctaactaagaaatttctacgcaagaaaataaaaagaaaaatcaaaacaagcgcaataacgagagcaacttgccaaggcaatagcaacggttgcggtagaaataacaacgttaaatccgcgacaattaacaagacaactaaagttattaagtttaatttcatttttataaaagattaattccagcctctctaagcctaggctagttttatttaaatatgcaaacggttgcttcaaattttgcgatccatatcgtaaaaataaatttttcaggaaaatttacttgctaaaacaaacaacttctgatatttataccgcccgcaaaaattgggttcctaaaatagcagtcaggaacaaactaaaataacaagacaggaagtcgtgaaatccacgcttaattctgtatgtattaggagtgagagatgtcaagagcatcattgagcttgctagatttagcaggcgttaagccttatcaaatgaaaaaagatgaagaatatatgantgangagcaaattcttcatttcagaaaaattcttaatgcttggcacgagcaaatcgtggaagaagcttctcgcaccgttgcacatatgcaggatgaagtaaccaatttccccgatcctgcagaccgagcaactcaagaagaggaatttagtctagaattacgtaatcgagatcgcgaacgtaaactaatgaaaaaaatcgaagcaaccttgaagaaacttgataccgatgattttggttactgcgattgttgtggtgaagaaatcggcattcgccgtttagaagcgcgcccaacagcagatctttgcattgattgcaaaactttagctgaaatccgcgaaaaacaagtcgctggttaattcattctattgaaaaatacaaaagtgcggttaaaattaaccgcacttttttgcatttaaaaatgcaggaaaatccacttgcctttttctttacaagaaaagagccaagtcatttatttccaacaacaaaacggagtaaattattcttacttatatcaaaaatttgtttggcaagaagacaaaaaaatcaaaagaggttgccaaaacaagtgctcattctaaacgagttgagcgttctaatagccaaatgccaaaagcgcgagcaaaaaaatcagaacaaacacgtcgctatgataaaaatgtgattaaagcggctcaatttgatatttctccgcgtgattttagccgtaatgctctcaatgtagtggaaaaactgcaacgtcaaggttttgaggcttatatcgtcggtggatgtatccgcgatttattgctcggtaaaaaaccaaaagatttcgatgttgcaacaaacgcccgccctgagcaaatccaaaacattttccaacgccaatgccgtttagtgggtcgccgtttccgcttagcacatattatgtttggtcgagatattattgaagtcgccactttccgtgctaatcacagtgatgctcgcaatgaaaatcaagcgaaacagagcaatgaaggcatgttactgcgcgataatgtttacggtacgatcgaacaagatgcagcacgccgtgattttacggtcaatgcactgtattacaatccgcaagataatacgttacgagattatttcgagggcattaaagatctcaaagcaggcaagctacgcttaattggcgatcctgttacacgttatcaagaagatcctgtgcgcatgctacgctcaattcgttttatggcaaaacttgatatgttccttgaaaaaccgagcgaacaaccaattcgtgracttgcgcctttattaaaaaatattccgccagctcgcttatttgacgaaagcttaaaattattgcaggcgggacaaggggtaaaaactatcggttattacgccaatatggtttatttgaacaacttttccctgcattaagcgcatattttacagagaaagaagatagctttgcggaacgtatgatcgtcactgcacttacttctacggatgaacgtgttgcggataaacttcgtattaatcctgcattcttatttgcagcatttttctggtatccattgcgcgaaaaagtggaaattttaaaaaatgaaggtggtttaaataatcatgatgcttatgctttagcaggcaatgaagttttagacttattctgccgagctttagctgcaccacgtcgtcatactgcggtcattcgtgacatttggttcttacaactgcaattattaaaacgtactggatcagcaccaatgcgtaccatggaacatccaaaattccgtgcaggctttgatttattggctatgcgagcagaaattgaaggtggcgaaaccattgaattagccaaatggtggcacgaatatcaattcagcaatggtgaacagcgtgaacagttgatacaagagcaacaacgcttacatcctaaaccaaagaaaaaatactaccgtccacgccgtcgtaaaacaacgtgctcagcagaataagggaaaagatgattacggcatatattgctctaggtagcaatttaaacacaccagtagaacaattacatgctgcgcttaaagcgataagtcagttatcaaacactcatttggtaacaacgagctctttttataaaagcaaaccgctcggcccacaagatcaacccgattatgtgaatgccgttgcaaaaattgaaaccgaacttagtccgctcaagctattagatgaattacagcgtattgaaaacgagcaaggtcgagtgcgtttacgtcgctggggcgaacgcacgttagatttagatattttgctctacggcaatgaaattattcaaaacgaacgcttaacaattccccattatgatatgcataaccgtgagtttgtcattgtgccgttgtttgaaatcgcatcggatttagttttaccaaatagtcaaatcataacagagctggtcaagcaatttgctgaccacaaaatgataaaattaaatccctagaaatttcaccgcacttttatgaacctcaaaagtgcggtagaatcagcccacatttttcttcattcatgacccgttatggaaagtttgactcaatatatccctgatgaattttctatgctccgcttcggcaaaaaatttgccgaaattcttttaaaattgcatacagaaaaagcaattatggtttatcttaacggtgatcttggggcaggaaaaacaacgctaacgcgcggaatgttgcaaggtatcggtcatcaaggtaatgtaaaaagcccaacttatacgctggttgaagaatacaatattgcaggcaaaatgatttatcattttgatttatatcgtttagcagatcctgaagagctcgaatttatgggcattagagattattttaatacggatagcatctgcttaattgaatggtctgaaaaaggtcaaggcatattgccagaagcggatattttagtgaatattgattattacgatgatgcacgaaatattgaattaatcgcacaaacaaatttgggtaaaaatattataagcgcattttctaattaacttatttatgaaaactaaaattttatttttcctttttttctcaacgtttagtttctctatttttgcagcacctattacgattgcgattgacccaggtcatgggggaaaagatcctggtgcaatcagccgaaacttaggcatttatgaaaaaaatgttaccctttcaattgcaaaagaattaaaagccttattagataaagatccacattttcgcggtgtattaacgcgtaaaagtgattattatatttccgtgccagaacgttcagaaatcgcacgtaaatttaaagcgaattatcttatttccattcatgccgattcatctaaatcacctgatcgtcgcggggcttctgtttgggtattgtcaaaccgtcgagccaatgatgaaatgggtcaatggttagaagacgatgaaaaacgctcggaattacttggtggagcgggaaaggtgctttcacacaataatgacaaatatcttgaccagactgtacttgatctgcaattcggacatagccaacgtacaggctatgtgttaggcgaacatattttgcaccattttgctaaagtaacaacattaagtcgcagtacgccacaacatgcaagtctgggtgttctacgttcgccagatattccttctgtgttggtagaaactggatttctttccaattcagaagaagaaaaaaaacttaattcccaaacttatcgtcgccgcattgcttatatgatttatgaaggcttagttgcattccatagcggtaaaaccaacactttagttaaagacaatttagtgcaaaacatcaaacaaaacgatataaaaaaatcagggaaaaataaccgcacttcagaacaaaatataaatgaagataatattaaagacagtggcattcgccatattgtaaaaaaaggagaaagtttaggtagcttatcaaataaatatcacgtaaaagtctctgatattattaaattaaatcaattaaagagaaaaacactttggctaaatgaaagtattaaaatccctgataatgtcgagataaaaaataaatcattaacaattaaagaaaatgattttcataaaaaacaaaatagcttagtaaataataccaataaagatttaaaaaaagagaaaaatacacaaactaataatcaaaaaaatataattccgctctatcataaagtaacaaaaaaccaaacactttatgctatttcgagggaatataacattccagtaaatatactattgagcctaaatccacatttaaaaaatggcaaagttattacaggacaaaaaataaaattaagagaaaaataaatgcctattaaaattctttccccacaacttgctaaccaaattgctgctggagaagtggtagaacgccctgcatcagtggtaaaagaattagtggaaaatagccttgatgcaggtgcaaataaaatccaaattgatatcgaaaatggtggggcaaatttaatccgcattcgtgacaatggctgtggtattccaaaagaagaattaagcctcgctttggcacgacatgccacgagtaaaatagccgatcttgatgatctcgaagcgattttaagtttaggttttcgtggcgaggcattagctagtatcagttccgtatcacgcctaacccttacttctcgtaccgaagaacaaactgaagcgtggcaagtttatgcgcaaggtcgtgatatggaaaccacaatcaaacccgcatcacatcctgtcggcacaacagttgaagtcgccaatctttttttcaacacaccagcccgccgaaaatttttgcgcacagataaaacagaattttcccatattgatgaagtcattcgtcgtattgctttaacgaaattcaacacagcatttacattaacgcataatggaaaaattatccgtcaataccgtcctgccgaagcaatcaatcaacaactaaaacgtgtcgccgctatttgtggggatgattttgtcaaaaatgccttacgaattgagtggaaacacgatgatttacatttatcaggttgggtggcgacaccaaattttagccgaactcaaaatgatttaagttattgctatattaatggccgaatggttcgagataaggtaatcagccatgctattcgacaagcctatgcacaatatttaccaaccgatgcttatcctgcgtttgtgttgtttattgatttaaacccgcacgatgtagatgtcaatgttcatccaaccaaacatgaagtacgctttcatcaacaacgcctcattcatgattttatttacgaaggcataagtcatgcgctaaacaatcaagaacagattaattggcatacagaccaaagtgcggtagaaaatcacgaagaaaatacggtgcgtgagccccaaccgaattacagcattcgtcctaatcgtgcaactgcggggcaaaatagctttgcgccacaatatcatgaaaaaccacagcaaaatcaaccgcacttttctaacacaccaatgtttccaaatcatgtaagtactggttatcgagattaccgttctgatgcaccgagtaaaactgagcaacgtttatatgctgaattgttacgcacgttaccgcctacagcgcaaaaggatatatcggatacagcacaacaaaatatttcagatacagctaaaatcatctcaactgaaataattgagtgttcatcacatctacgagccctttcacttattgaaaatcgtgcgttgttattacaacagaaccaagatttctttttgctttcattggaaaaattacaacgcttgcaatggcaactagcgttaaaacaaatacagattgaacaacaggctttattgattccaatcgtgttccgattaaccgaatcacaatttcaagcatggcaacaatattcagatgacttcaaaaaaattggctttgaatttatcgaaaatcaagcacaattacgcttaaccttaaataaagtgccaagtgcattacgcacacaaaatctacaaaaatgcgtgatggcaatgctgactagagatgaaaattcatcatcatttttaaccgcactttgcgcacaattagaatgcaaaacctttaacgctttagcggatgcactcaatttattgagcgagacggaacgtttactcacgcaaacaaatcgcacagcattcacccaattactcaaacctgttaattggcagcctttattagacgaaatttaaattcttcatgaaaccaaccgcaatttttttaatgggcccaacagcctcaggtaaaacagatttagccattcaactacgaagccaacttccagtcgaagtgattagtgtggattcagctcttatttataagggaatggatattggcacagcgaaaccatcaaaagaagaacttgcccttgcgcctcaccgtttaattgatattttagatccatcagaaagctattccgcaatgaatttccgcgatgatgcgctacgcgaaatggcggatattaccgcacaaggcaaaattccgttactagtgggcggcacgatgttgtattacaaagccttaatcgaagggctttcgcccttgccttctgctgatgaaaatattcgcgccgagcttgaacaaaaagcagctcaacaaggttgggcagcattgcatacagaactcgccaaaatcgatcccatttctgccgcccgaattaatcccagtgattctcaacgaatcaatcgcgctttagaagttttttacatcacaggaaaatcactcacagagctgactgaagaaaaaggcgaagccttgccttatgattttgtgcaatttgcaattgcgccgcaagatcgccatgttttgcatgaacgcatcgaacaacgctttcataaaatgattgaactaggctttcaagcagaagtggaaaaactttatgcgcgtggcgatttaaatattaatctgccgtcaattcgctgtgtaggctatcgtcaaatgtgggaatatttgcaaggtgattacgcttacgaggaaatgattttccgtggtatttgcgctacgcgccaacttgcaaaacgccagcttacttggctgcgtggttggaaaacaccaatacaatggctagatagtttacaacctcaacaagcgaaagaaactgtattacgtcacttagattcttatcaaaaaggttagaaaaaatgaccgcactttctgccctcatcgaacaaaaattacaatctcttggcacaatcctgtgccaatcttttccagaactttccccagaaaaaattcacgaagccattcaacaaaattcaaatcatccagaactgcctgtttatcaattaggctatgccatagcaatgtctgactttgtggaaaaagtcttgcaaaaatacccgcacttagtgaaacaatggtgggaaaaatccccctgttttgcagattgcactgcctatattgaacgtttgaataaagagttagccaatgtacatgacgaaactgctctctatcaaacattacgccaattccgtaacattgaaatggcaaaattaagtttttgtcaaagtttgaatcttgcgacagttgaggaaatttttgttcagctttcacaacttgcagagagtttaattatcgctgcccgcgattggctttatcatcaagcctgtgcggagataggcacaccaatggatgaacaaggcaatccgcagcagctttatattctaggaatggggaaattaggcggctttgaactaaatttttcctcagatattgatttaattttcacttatccatcacaaggggaaacgtccgttgagaatacgaatgctcgacgttctgtggataatggaaaattttttacacgtttagggcaacgccttatttctgccttagatgaatttacctctgatggttttgtatatcgaaccgatatgcgcttgcgcccatttggcgatagtggcgtgcttgttctcagcttttcagcaatggaacaatattatcaagatcaaggtcgagattgggaacgctatgcaatgattaaaggacgagtattgggcgcacaaacaaaggatcccaacgtttcaaaattgaaaaaaatgttacgcccttttgtctatcgccgttacattgactttagtgtgattcaatctttacgtgaaatgaaaggcaaaattgagcgagaagtacgccgtcgtggtttgaaagataatattaaactaggtgctggtggtattcgtgaagtcgaatttatcgtacaagtttttcaactcattcgaggcgggcgagaaatcaatctgcaacaacattcactcttaaagatcttgcctgaaattaccaaactaagattaattaccgaacaacaattccacgatttacgtgaaagttatatttttttacgccgcgtagaaaacattctacaagccattaacgatcaacaaacgcaaacactaccaaccgatgaaatagatcaaattcgtttagtcgaggcatgtaaaactttcacctgtttaaatgaaaataatcaaaccattgaaaaacattatccaatagaaaattgggacgatttttaccgcactttacaacaaaaacaagaaaaagtgcgggcagtatttactcaattaatcggtgatgaacaagatgagtcttcacaaactgatagccaatggcaagattttttagaagcagattttgaggatattgaacaaacattattagagagtagtgtatcggaaaataatattgatgaagttttagaaaagcttgctcaattcaaagacggcctaaatcacagagtgattggttcgcgtgggcgtgatgttttgagtcatttgatgccaacagtacttgcactcatttttgaacaagaaaattaccgcactttgcttccgcggattctgaacattattgaaaaaatttcgagtcgcacgacttatttagaattattattggaaaatcctcgcgcacttcagcaagttattgaactttgtgcgcagtctcaacttatttcagaacaattggcgcactatcctattttattagatgaattgcttaatacggaagcactacgtcatcctttgccatttacccaatatcctgcagagttacaccaatatttgcttcgtttaccccctgatgatgaagaacagcttatcgatgctttacgtcaatttaaacaagcaaccctattaaaagtggcagcggcagatattttaggtgcattgccagtaatgaaagtaagcgatcatttaacctatcttgctgaagccattattgaagtggttgtgaatctagcttggaaacaagtttcctctagatttggtgtacctgaacatttacaaaataacgaaaaaggatttttagttattggttatggaaaactaggtggtattgaactcggttataaatccgatttagacctcgtatttttgtacgatgccgtagaaagtcaaacaacaggtggcaaaaaagtgattgatagcaatcaattttacctacgcttggcacaaaagattgtgagtattttcagcataaatacttctgctggcgtactttatgaggcagatatgcgcctgcgcccttctggcgatgctggcttaattggctgctctctttctgcattttctcattatcaattgaatgacgcttggacatgggaaaaacaagcacttgtgcgcgctcgtccagtatttggcgaatcatctcttaaagctaaatttgagcatatccgccaacaagtgctttctgcatcacgagatattgaacaattaaaacaagatgttgttgagatgcggaaaaaaatgtttgcccatttatctcactcaaaacacagtgaatttaaccttaaaacagatcgcggtggcattacagatatagaatttattgctcaatatttaatgcttgccaatgccccgaaaaaaccacaactaacaaaatggtcagacaatgtacgtattttcgatgatatggcagaggctaaaattattagccaaacagactgcgacacattaaaacaatgttatgtcgatttacgcaataccattcatcatttaaatttgttgggtaaatcttccgttgtggaagacagtgaatttgttaaagagcggtcatttattcaagcattttgggataggttatttgtatcctaaaatatggcttgtggacgtttcaaaaatagccttcatcacaaatcttcttgaaacctcccaaaaactaaatattcaatcctatttttaatgaaccaaatctaacatttcctgtgcattggctagagctaattctgtaatttcacttccgcccaagagtcttgccaacgcaggtacacgttcagcttgtgaaagtgcggtcatttttgtttcagttttattatcaacagtaaatttttccacattaaactgatgatggccatgacaagcaacctgtggcaggtgggttacgcataatacttgacaacgctcacttaattgacgtaaaagttttccgacaacacttgctgtttttccgctaatgcccacgtccacttcatcgaaaattaaggttggaatagccgattgatcagaagttaaaacttgaatggctaaagaaatacgagaaagctcaccaccagaggcaattttagctaatggctgcggttgttgtcctaaattactacgcaaagtgaaaatcacattatccgcaccatttgcactcactttatctaaatccgtattcaactctacataaaattcagcgttttccattgcaagttgttttatcgactgtgtgacattttgcgctaagcgggttgcagattgctgacgacttgctgttaatgctgtagccgttgcttgcatttgttcaaatgctcgtttttcttgctcaatcaacatctcttcactttcagaaaaatctaaaagtgcggttaattctgcttttaattttttgtgctgttctacaagatcttcaggtttaacttgatgtttacgagcaagttgtaaagtctgactaattctttgttcgatttcctgtaaaagctgaggatcttgctcgatattacttgataaattttgcacttcactggttgcttcttgcacttgaatcaacgcatcattcaacatattttgcacttcagcatattgcggatcaagttcagctaattcatcaatatattgtgtcgcacgataaagcaaactatcgatatttacggtgtcattttcacttaaaatttgtagggctgattgggaaagttgagttagctgttcgctgctagataaacgacgttgttcatcttctaattccaaatattcatttggtcgaaggttaaattcatctaactcatccacttgatactgtaaaagttgtttacgtgcttcattttccgccactttttgttgaaaggttttaacttgattttgaagatttttccatgtctgataatcttcacgcattttcacaagtaattcaggatgagcggcaaaattatcaactaactgaagctgatagtcattttttaacaataattgagaagcgtgttgcccattaatatgaacgagatattgagcaatttcttttaattgagaagcggatactggtgtactattaataaaagccttagaacgtccgtctgcattaattatgcgacgtaaaatacattcagttggattatctggatcctgtaattcttgctcactcaaccagtgataagcaggattttgcgattctagttggaaagttgcacaaatttccgcacgctcttgcccttcacgcaccattgaggtttctactctttgtccgaaacataaacctaaagcatcaatggcgatagattttccagcaccagtttcccctgttataacagacattcctttcgccaattcaatatcaagctgacggacaatcgcaaaattattgatagtaagttgagtaagcatagcaaaatcctttaactgtatatttaatatgatataactgacttaatttacagtaaaggattttttacagtattttgtcaaatctatttcaatcgaaaatttttaccataatcaaaatgattttaaccaacctaatttgctacttaacacattgtaataattataattttcagatgaagcaatcggagtttatgctcgcttttttgaatatgcaccacatcatctggggtaaaaggtaaggtaatttgactatcacagcccacttctaattgagaggtattatgttcagcaaaacgaatcgatattttactatccccatcaacaacaagagggcgagaagttaatgtatgtggaaacattggcactaatgcaatggcattaaggtttggtgtcaaaataggtccaccagcggaaagagaataagccgtagaacctgttggagtagaaacaattaatccatcagaacgttgagaaaatgcaaacttatcattgatatatacgtgaaaatcaatcatatgtgcaattttggcgggatgaataaccgcttcatttaccgcattgctggttgatacgatttcacttgctcgttcgatttttgcttccaataaaaaacgttcttccacaaaaaattcgccacgttctaaacaagcttcaagctgggaataggcatttttcgggtcaatatccgttaaaaatcccaaattaccacgattaataccaatcaatggaatatcatattttgctaatacgcgagcgcgccctagcatattgccgtctccaccaatcacaatggctaattgggctcggtggcctatttcttctaacgtagcaagatgttcaaaaggtaactcaagtgttatggcgacttctttttccaccaacacttgataaccacgttccattaaccaatgaaataagtttttgtgcatttgtaagttaatatcattgcgaggcttacctacaagagcaatggttttaaaggaacgatataaatgattcataaaatgaccgcacttgaatttaacattttcgtcattatatcgttttttgctacactatgcccaattacgattaatcaattttgttttacggagaaaaaaatgtcagaacaagaacaaaaagttgaaatcccagaagtagaaaagcaagaagaagtcgttgtggaagaaacacaacaagcagagcattctcaagaatttgatcctttagaagaagcaattgctcgcgtgcaagagcttgaagagcagctaaaaactcaaatagaagaagcggcaaacaaagaacaggatattttacttcgctctcgtgctgaaattgaaaatcttcgtcgtcgtactgaacaagacgtagaaaaagcacataaattcgccttggaaaaattttcaaaagacattttgaatactatcgataacctagagcgtgcccttgccactccagcaaataaagaagatgaaagcgtaaaagccttatttgacggtgtagaactaaccttaaaagaattagtttcaaccgttgggcgttttggcgtggaagctgtgggagttgtcggtgaagcatttaatcctgatttacatcaagccatttcaatgcaaccagctgaaggctttgaaaccaatcaaattagcgtcgtattgcaaaaaggctacaccttaaatggtcgagtcattcgcccagcgatggtaatggtggcagcttaatttacattttgtctaaagagcggtcggtttttcgaccgttttttctttttcctgaataactacataaactttacggataatttccctaaaatcttcgctcgttgtagcccaatctagaagatcaacgcgccacggtaaatctgattcagaaaaagcttcctttaatctgtcacgagctaaaaaatctaaaggttcctcagagataatcgcaaggtcaagatcggaatatttttttgcttttccctttacacgagaaccgaaagcccacacggtataatcaggtactaattgttgtaaaatagttttcacaatcgccaattcttcagattttatatcaagctgtgcaaaactagtcatattgatttctctgacgtaattgttccaataggaaactactttctattaaaaaatcatcaatttgtgcataaacagccatggctttttcctgatcataagtatgtgatgtaatattacgcatatcacgataagcaacccattttgacatatctccaatcaaaccaaatctcaatgcttctcgcaaaatatccttaaatccataagccccaatgtcatcggtattaattgcatcttgttgaagttggcgtttcatcatttttaaacttaactcataaacaaattcaaatttctgaattgcacctgcaattaaggtatcttgtacaatagagggttgcatatcaaaccaatttctgtctgaaatttgtactacggtttgctctaacgaataaaatgcagcatctaatacatttaaatttagcttatcagtcatcatttttacctctgttaaatactcatctattttaccatagactattttttctcaaaacctataaccccaaaagtaaacattgtgatattgatcacaaaatcaaaaatatttgagaaaagctctcaacaacttaatttgatatttttctaataaaatcaatctttaacaaaattatcttacgacaaaaaggtctaaaacactacatattgtgtgttgattatctttttagatctatatatagtgcaatccgcatttcaaaaacactatatattggagctatatcatgagtaactttggggtcatcaagcgcgatggttctcgtgcggagtttgagattcaacgtatcattaatgccattaaaaaagccgcaagtncggtcaatatttccgatgaattttattgccaccaaattgggcaagaagtagggaatgaaattttcacccgtcatcaaggcgagattgatattaatcagattcaaaaaatcgttgaagataaattgatggcaagtcgttatcctgaggttgctcgtgcgtatatcgaatatcgtcatgatcgtgatttagcacgagaaaaacgtagccagctaacaaaagaaattgaaggtttgattgaacaaagcaacgtagaattacttaatgaaaacgccaataaagacgcgaaagtgattccaacgcaacgagatttgcttgctggaattgtggcaaaacattatgccaagcacaatattcttccacgcgatgtggtagaggctcacgaaaaaggtgaaattcattatcacgatttagattacgcgccgttctttccaatgtttaactgtatgttagttgatttagaagggatgctttctcgtggtttcaaaatgggcaatgcggaaatcgaaccccctaaatctatcggcaccgcaacggcagtgacagcacaaattatcgcccaagttgccagccatatttacggtggcacaaccattaatcgtattgatgaagtgctttccccttatgtgcaaatcagttacgaaaaacacctcaaacatgcccaagaatggaacgtgcctgatgttgaaggttatgccaaagcattgattgaaaaagaatgtttcgatgccttccaatccttagaatatgaagttaatacactacatacttcaaatgggcaaacaccatttgtgacctttggttttggtttaggtacaagctggcaatcccgcttaattcagcaagctattttaaaaaatcggattcgtggacttggaaaaaatcataaaacaccagtatttccaaaacttgttttcaccatcaaaaaaggtttgaaccaaaataaaggcgatccgaattacgatatcaaacaactcgcattagaatgcgcatcaaaacgtatgtatccagatattctcaattacgatcaggttgtcaaagtcacgggctcttttaaagccccaatgggatgccgtagctttttaggtgcatacgaagaaaaaggccacgaaattcacgatgggcgtaataatcttggcgtggtgagtttgaatttaccgcgtattgcgttggagtccaaaaacgaagaagatttctaccgcactttagatgaacgtttggctattgcgaaaaaagcattaatgacgcgcattgcccgccttgagaataccaaagctcgcgtcgctcctattctttatatggaaggtgcttgcggagtgcggttaaaagcggatgaaaatgtggcacaaattttcaaaaatggacgtgcctctatttcacttggctatatcggtattcacgaaaccattaatgcactatataacaaaggacatatttttgatgatgaacaattacgcgaaaaaggcattgcgattgttcgccaccttagcgaggcagtgaaacgctggcaaaaagaaacaggttatgccttcagcctttactccacgccaagcgaaaacttatgcgaccgcttctgccgtctagataccaaaaaatttggcgtaattgaaggcgtcacggataaaggctactacacgaacagttaccacttagatgtagaaaagaaagtgaatccttacgataaactagatttcgaaatgacatatcccccactcgccagcggcggttttatttgctacggcgaatatcccaatattcaacacaacttaaaagcattggaagatgtgtgggattatagctacgatcgcgtaccttactacggcacaaacacaccgattgacgaatgttatgaatgtggtttcaccggcgaatttgaatgtaccagcaaaggttttgtctgcccgaaatgtggcaatcacgacagcacaaaagtgtctgtcactcgccgcgtctgtggctatctaggcagtcctgatgcccgcccatttaatgcgggaaaacaggaagaagtgaagagaagagttaaacacctttgattaacacgatagcaaaagcacgcattttttaatgcgtgctttttgtttccaactttggcattcctaaaaatctccgctaaaataaccgcactttttcttatcttctaggaaagcaatatgtcagatattctcaataaccttattcatcttcttaaacttgaaaaaattgatgatttaatctttcgtggagaaagccaagatttaggttttcgtcaagtatttggtgggcaagttgtggctcaagcattatcagcggcaatgcaggtggcgccagaagatcgtattttacattcttgtcatgcctattttcttgctccgggagatagccaatatccgattatttacgatgtagaaaccttgcgtgaagggcgtaacttttctgcattatgcgtaaaagccattcaacataaaaataccatttgtcatgtaaccgcttctttccaagtgcctgaaaaaggttttgaacatcaaaatacaatgccaaatgttggtgcgcctgaagactttacggatgaaaatgtgatgctacaaaaagtagctcaaaccttgccagaaccactcaatgaaaaatttgcagcagagcgtccatttgaggtgagaacaaaatatttgaataacccatttaacgggacaaaattgccagccgagcaatattcttggtttaaaaccaatggtgaaacgccgcttgatataaaaattcagcaatgtttattagcttatttttccgattttcactgtattttgaccgcacttcatccgcacgaaaaaggctttttacaaaaaggaatgaaagtggcaaccattgatcacagtatttggttccatcgtccgtttgatttaaatcactggcatttgcacgcaattgaaagcaataatgcctttggaggtcgtggtttggcccaagggcagattttctcgcaagatggtcaattaatcgcaacaacacaacaagaaggcttgatccgttttagcgaataagagagaaaaaatgaccgcacttattacacaattttggcaacaagttgaaactgcgctgaaaacagcaaatccacaagaaaaatgtcgtttagtcaatgatctctacgataatcttctgccacaaattcagttgattaaattagaagattttcccgaaatcgtgccgcaagataatattgccgcttttcctgaaaaaccgctcttagttgcaccgaaagatgtgccaaaacgttcttttgccacagaagaaggctatgctgccacattacacgctatcgcacatattgagtttaatgccattaatttaggcttagatgcggcttggcgattcgggcgtaatgcacaagaagaacttggcgaaggtttagcttttgtgaaagattggctgcgtgtcgctcgtgaagaaagcacgcatttttccttagtcaatgaacatttgaaaacattgggttatcaatatggtgattttgaagctcatgctggattatgggaaatggcgcaagccactgctcacgatatttgggaacgaatggcgttagttcctcgtgtattagaagcaagaggcctcgatgcaacacctgttctgcaagagaaaatcgcacaacgtaaagattttgccgcagtgaacattttggatattattttgcgcgatgaaattggccatgtgtatatcggcaatcattggtatcacgccctttctaaaaaacggggtttagatgcgatgaaatgttttacagagctgttacacaaatatcgtattgtaatttttaaaggtgtcattaataccgatgctcgcattcaagcaggtttcactcagcatgagttggattggatttatgaagtggaacaaacattaaaatcctatattaagaaatgatgaaaaaataaagagactaagttcgattgaataccgaacttagtccttttaatgaaagtgatttaacgtttgaatttattgcttacgccaagttgtcccattcggcccatcttctaatacgatgcccatagctgtcaattcattacgtgctgaatctgcggcagaccaatctttagcagtgcgggcttcgttgcgttgtttgatgagtgcctcaatttttgccacttcatcatcgttagaacctgcttgtaagaatttctctggttcttgttgaagtaatcctaaaatcgcccccaattcacgcaaacgtgcagcaagtccattagctttctcaacatcttctgtttttaacttattaatttcacgtgccatttcgaataaaacagaaagtgcatttggcgtattaaaatcatcatccattgcttcacggaaagttgcaacaaaattttctccgccaaaagcaaccgcactttgatctgttccgcgtaaagccgtgtataaacgttccaacgcaccttgtgctaaattcaagttttcttcgctataattgagctggctacgataatgtgccgttaataagaaataacgcaccgcttctgcattgtagtggtttaatacatcacgaattgtgaagaaattgccgagggatttcgacattttttctttatccaccataatcatgccagaatggatccaataattcacatattggccgccatgcgcacagcaagattgtgcaatttcattttcgtggtgagggaacattaaatcagagccaccaccgtgaatatcaaaatattcgccaagctgtttgcagttcattgcagaacattcaatatgccaacccggacgacctgccccccaaggggaagcccaacttggttcgttttctttcgacattttccaaagcacgaaatccattggatttttcttgatttcattgatttcaatacgtgcgccagcttgtaattgctcaagatcttgacgggataatttgccgtattctttgaagctttctacatcaaacatcacgtccccattatccgcaacataagcatgtccgcgtttaattaatttttccacaatttcaataatttctggaatatgatgcgtcgcacgaggttcaaaatcagggcgtaagacattaagtgcatcaaaatctttatacatttcctgcaccatgcgatccactaactgatcgcaggtttctttgttttctaacgcacgtttaataattttgtcatctacgtccgttatattacgcacataagttaaatcgtaacccaaagaacgtaaataacgggcaatcacatcaaaacacacaaaagtgcgtccatggccgatatggcacaaatcataaacagtgacgccgcaaacatacattcccactttattttcgtggataggtttaaagatttctttttctctcgttaaggtattgaaaatttttagcatttttaagctcgtaaaatgaaataaaaacaaaccgcacttttatagcacttttacctcgattgtggaataatacaacccttaattttttagagggaaaacaaaatggttacattacacacaaactttggcgacattaaaattaaattggattttgataaagctccagttacagcagaaaacttcttaaattactgcaaagacggtttttataataacacaatttttcatcgtgttattgatggctttatgattcaaggtggcggtatggaaagcggtatgcgcgaaaaagcaactaaagccccaatccaaaatgaagcgaacaatcgtttaagtaacaaacgtggaaccattgcaatggctcgcacttcagatccacattcagcgacagcacaatttttcattaacgtggcagacaatgatttcttaaattatcgttcaaaagaaatgtttggtcgcgaagtcgttcaagaatggggctatgcagtatttggcgaagtggttgaaggtatggatgttgtggataaaatcaaaaaagtgaaaacaggcaacaaaggctttcatcaagatgttccaactgaagatgtagtgattacatcggtttctattgagtaacaaatgagcataaaacaacatcgccctaaagttggagaaattctagaatgtgattatggtcaattttcgcatacctgtcacgttgatggacatattccacctgaaatggttaaaaaacgtttggttgttgttttgaatgctaaactgaatgggcttattttagttgcaccaatttcatctaaaattaatttagatggtataaaaaatggctatcatattgaaatagattcagaattaataaaagcaacaggcttttatgataaaaggactcgctggattaaatctgaattaattcaatcagtaagtcgtctccgtctgtatcatatttatgataaaggaactaaaattactcaatatttgccaagggatgttgtaacaaaagttcaaagagctatcataaaagcaatcaatgcaagctcattacttgacaagtagatagaatacagtatagacttccgagcgtaacgccttagagcgatcatcatcgaaagatgagtttttaaacgccattgagcgatgaatcccctgattagcgataattaggggattttttatagaatttagataaagatatttatgcacttcttcgacactcacacgcatcttaattatctccaacaatttactggggaaccgttgtcacagcttattgataatgctaagcaagccgatgtgcaaaaaatactggttgtggcggtgaaagaagctgattttaaaacaatccaaaatatgaccgcactttttcctgataatttgtgctatgggcttgggctccatcctctttatattcaagaacacgccgaaaatgatttgattctgttagaacaagccttaaaaaatcgtgatacaaattgcacggcagtggcagaaattggtttggaacgcgcgattcccgatttgctcaccgatgaactttgggcaaaacaatgtcatttttttgaaagccaactttatttggcaaaacaatttaatttacccgtcaatattcacagtcgaaaaacccatgatcaaatttttacttttttaaaacgtattccattatctaaacttggcgtggtacatggtttttcaggaagttacgatcaagcaaaacgctttgttgatttaggctataaaatcggagttggcggcactatcacttatgaacgagccaataaaactcgtcaagcaatcgcgaagttgccgcttgatgccttagtgttggaaacagacagcccagatatgcctgtatttggttttcaaggccaacctaatcgaccagaacgtattgtggaaagttttaaagctctttgcaccttaagaaatgaacctgctgaattgattaaaaaacttacatgggaaaatgcttgccagattttttcttgatccacgtcacattactgaaattattttgaattaaatactagaaaaaagaaactggcataataatatccgcctcgtagaaagtttttctcaacacacaataaggatatattatgtcgcaaatctatactcaggtgagaaagttagcggaacagtttattgagccttacgccgacgaactcgatcaaaaaaagaggcatttaaggaattaggtaaagctggttggttttcacttttaattccaaaagaatacggcagaatgggattaaccctaaaagaacacgctgaagtctgtatggcattagctgaaagttcagcctctgctggtctctgttatatgatgagtaacgttgcagtgaattgtttaaatctattcggcagctatcaactcaaacaaaaaatcttttctgacattgttcaaaataaaacctttgccgcactcgcctatagtgaattaggcacgggtactcacttctattcgagtttttacatcaacatggcttggaatttggtcaagattatgtagaaaaacgctttgatgtgggtgttggtttgcacggtgatcatgtaggcggtgaattaaattcagccaatgcattcaccgaaaccttgttcaaaatggattacaacaatccagaacataaagaaatgatggatttggaaggattaaaacgttggattgcgcgcagaaaaagccttaaattaccttccaccagagcaaatatcaaaatttcagacaaaaaattgccccattaaggggcaatcttatcaatgttctaaagttacttatagctttaaacaacgattaaatatgttggttaatgaagttagccaattgagtttttggtaatgcaccaacttgagttgcaacaacttgaccatttttaatcaataataatgttgggatactacgaacaccaaattgtgctggcgttgcttggttatcatccacattcattttcacgattttaactttacctgcaaattcaggtgcaagttcatctaacactggtgcaatcattttgcaaggaccacaccaaggtgcccaaaagtctaataaaatggggatatctgaattaactacaacactttcaaaatctgcgtcattaatgtgtaatacttcgctcattttgttttccttattttgtgaatggaatccctatataagggctttttttaaacttacaagtgcggtgcagaataacaccgttttaaaaaatgtaaactaatcgttttaattgccgaaaactaagacggcaaaacaatattttcacacactttacccgatttcaatttataaatgtttgataaagtcacgtctgcaatattggttagtgcttcttcggttaaaaacgcttggtgacctgttagcaatacattatggcaagaagataaacggcggaaaatatcatcttgaatcacttcgttagacttatcttcaaagaataaatcacgctcattctcgtaaacatccatacctaacgcaccgattttacgctgttttaacgcatcaatcgcagcttgagtatcaatcaaagaaccgcgactcgtattaacgatcatcacgccatctttcatttttgcaaaagcctcgcaatttaataaatgatagttttctggcgttgctgggcaatgaagcgtaatcacatgagatttagcataaagttcatctaattcaacatattgtccccccagttcttctactactggatttttgaaaggatcgtacgccaagatattcatgccaaaacctttcaaaattcgcatcactgcgatcccgatttttcctgttccgattacgccgactgtgcgtccgtacatattgaaaccaattaacccctcaagagagaaattcgcttctcgggtacgctgataagcacgatgaattcgacggttcagagtcatcatcaaaccgatggtatgttccgccaccgcttcaggcgaataagctggaacgcggacaacttggatgcctaattcttgagctgcttttaaatcaacattattgaaaccggcacagcgcaaagccacaattttcacaccaagtgcggctaatttttctaatacttttcggctaccattatcattcacgaaaatgcatactacttcgcaatgttctgccaaacgcacagtgctctcgttcaacataaaatcaaaaaattctaaatcgaaattatatttcgcgttaatgagctcaatatattttctgtcataacttttagtgctatagattgcaattttcatggtttgctccaattattttaagtttgcaaaagcttgtaataagtccgctttaatatcttctacatcttcaataccgactgaaaaacgcaacaaggtattagtaatcccacgagctacacgctcggattctggaatatccatatgagtttgagtggcaggataagtaataaaactttctgtgccgcctagactttctgcaaaagtaatcaatttgatggattttaaaaatgtattaacccaagcttcatcttgcaaacggaaagacaacatcccacctttattcggataaagcaccgattccacttgtggttgagcttttaaaaattccgcaatagcttgtgcattttcttgatggcgtttcatacgcaaagaaagggtcttcataccacgaatagtcagccaagaatcaaaaggagaaagcaccgcccctgcaccattttgaatataagcaatgcgatcacaaagttcttgccctttcgcaacaattaaaccaacaagtgcatcattatgcccagcaatatatttagttccgctgtgaattaccacatccgcacctaaatctaatggacgagaaagcacaggcgttaaaaacgtattatccacgatcaacattaagttatgttttttcgcaagttttgcaatttcaaccacatcacattcttccattaaaggattcgatggggtttcaataaaaatcgctttcgtatttgggttaatggcagcctcaattgctgaagcagatgctgtattaacataaacaggttttacactattgttatttttataagaaaaatctaataatcgataagtaccaccatacacatcgctagaaacaatccattcatctggggcggtaaaaagcgtcatcaaaacttgaattgcagccataccagaagaaaacgcaaaaccacgatctccattctctaatttagctatcgtttcttctaatactgtgcgagttggatttttggtacgtgtgtaatcaaatcccgtactttcaccgataccacaatgaccataagccgtagaaagaaaaattggtgcagaaaccgcgcccgtacgctcatcactgcgattgcctgcttgagctaataaagtatcgatagcatattgttgtgtcataacatcctctaaaaataatgaaaaaattgaccgcactttacgtgttaaaaaacgtttagcattttggcacaaaggaaaaagtgataaaagtagaaattagaaaattacataaaatttcatttttccatcattttctgtgatttatttgaacaaaatgaactttttttaaacggttagacaatttttttaaatctgtaattgacagttatctgaatttccgtaaaatgcgcaccaataacagcgaatgcgggaatagctcagttggtagagcacgaccttgccaaggtcggggtcgcgagttcgagcctcgtttcccgctccaattcgtggcgtgttagcaaagcggttatgcactggattgcaaatccatgtagctcggttcgactccgggacacgcctccataatacgcaaatgttagttgtctatatgcccgagtggtggaatcggtagacacaagggatttaaaatccctcgcctttcgaggcgtgccagttcaagtctggcttcgggcaccatttaaacaccaatccaaagattttaaaatttactttaaaatcatctaattgggtcgttagctcagtcggtagagcagcggacttttaatccgttggtcgaaggttcgaatccttcacgacccaccacttaaaaataaagtaagcaccgaaaggtgtttttttattgcctaaatctgatactactttttaaattacttgcttattgaaaaatagctattctctccatccaatctaaaataattaatatattttatcgctacgttatactttctaaataaaatagcacctgaaaatcagatgctatccaaaacacaataaaaatttaccgcactttatgacttcaataagtaagcccgtagttgtgcaaaatcattatccatttcatctgaaagcaatggtagctgattatgtttatccagtgtttcaggtaatggaagctgaataccaagaatacgttctacggattctttaaatttcgcaggatgcgccgtacacaggaagattcctgtttcactcgctttaagttgatctttcaacacctgataagctatcgcaccgtgaggttcacataaataacctttcgactgcatcgcttttaaggtatcttctgtttcgctatcacttagcatccccgaacctaaatcagttaaatcccaaccatttcgtttaaacaattcctccactcttggccaattatttgggcgacttacatccattgcattagaaagggttgcaactgtcgttttaggatcccaattacccgatttcaaataacgtggcacagtatcatttgcgtttgttgaggcgacaaagcgttttattggcaagcctaaggtttttgcaattaatcccgcagttaagttaccaaaattaccacttggcacagaaaccacgacattatcacgtttttcttttggcaattgtgcgacagcttcaaagtaataacaaacttgagctaataaacggctgatattaatagaatttgcagagttaagcccgatagcttggcgcaattcaacatcatcaaaggcttgcttaaccaaagcctgacacgcatcgaaatcagcgttaatcgcaacagtacgaatattcccacctaaagtacagaacagcttttcttgcaatgggctgattttgccttttggataaaggataactacattaatattttctaatccataaaacgcatgtgctacagcggctccagtatcgccagacgtagccgttaaaatagtaattttgccatcgccacgtaccgcagcaagtgcctgtgccataaaacgcccaccaaaatctttaaatgctagcgttggaccgtgaaataattcaagtgcataaatattttcttccactttttctaacggtgcaggaaaagtgaatgcatttttcaccatcgcatctaacgttgcttgtggtaactcgccatcaattaatgcacctagaattttttgactacgctcaacaagaggcaattcaagtaattcattaatgttattaagttgaggaataacttctggaaagaatagaccttgatcccgcccaagaccttgacgaacagcctgagaaaaagtgacttgttcttctgggtgtttgatattgtataaattcatatttaatccgtttttaatctgatttcatctatttaaattaacttatttaatttctcttgtgccttcgttatcaactttacatacatgcacaaaaccttcattattttgtaaataatggctttctaaataacttgaaagtttaattgcagtttgtaaatcaggggcaatagagaaaatagttggccctgagcctgaaatacctgtggcaagtgcgcctaagtctcgagtagcttgttttacttcagcaaaattaggtaacagagattcacgataaggctcggcaatgacatctttcatcataatcgcggcaagattttcctgatgggtatggcaagcatgcacaaagccacctaaatgacgaccatgggcaatcacgttttgtcgagtatagcttttcggtaaaattgctcgagcttcagcagtagaaacttcaattcccggataggctaacacccaataccaattatcaaaaaatggcaatttttgacaaatattgccgagcgattgcaccataaattgcacaccgccaagatagcaaggtgcgacgttatcataatggattgaaccagaaatacgaccttccaattctcccatcatttcaagcaattccattttcgaaaaaggttcattatgaaactgatttaatgccactaatgcagcaacaatagaacaagcactagagcctaaaccagagccaataggcatatttttttcgagcgttaaacgtaaaggtttaacatttgctccgcgtaattttaattgctcgctaaatagcacataagcttggtaaacaatatttttttgcggttctttcggtaatttacgaacaaaatagcccgcactttctaactcaaaaccagttgaaatagattctatttgaaccacatcgcctaacaaagaaccatcaataggagagatcgcagcacctaaagtatcgaaacctacgctaatattcgcgctagatgcaggggcgtaaattcttaacattgggaatccttattaatgttgtaatgttcttaaaatatctgcaaagatacctgccgcagtaactgcattacctgcgccataaccacgtaataaaagtggaatcggctgataatagcgagtgtaaaatgccaaggcattttcaccatctttcactttataaagtggattattcagatctaccgcaacgatggatactttgcattttccttcactaatttttccaacataacgcaatactttgccttctgctttagctgtggcaacgcgagttttaaattcttcatcaagctgaggcaacattgccataaactcatctgcagattttccatcggagaagccttttggcaatacaccttcaacttcaacatctgaaagttcaagttcaattcccgcttcacgagcaagaattaataatttgcgtgctacatcttgtccagaaagatcatctcgaggatctggctcagtaaagcctttttcacgcgcaagtgcggttacttctgaaagagaaagtccttcttccaacttaccaaaaataaaggaaagcgagccagataaaatcccttcaaaatattcaagctcatcacctgctgcaagtaagttttggagattttcaataactggcaagcccgcacctacattggtttcatataaaaatttatgctggcttgcttgggcattttggcgtaactcattgtaataaactaattctcgtgtattcgcttttttgtttggcgtaaccacatggaaaccttcttttaacgcacgagcataaagccctgctacagattcggctgaagtacaatctacaaatactggattcaccacatgatgtaatttaatgaaagaaagcaatacatcaaaatctgatggctgagtcgcattttctaaatcgtttttccaatcctctaaatttaatccattttcatcaagcaacatacggttggaattcgcaatagcacaaactcgaatttcaacattcttctttgctagatactccttttgacgctttacctgctcaattaattctccgcctactccaccaacgcccactaaaaacatatccacgacttttttattattgaaaagcgcctgatgggtagccttcaccgcttcaatggctttattttgcggcacaaccgcagaaattgaacgttcgctagatccttgtgcaatcgccacaatgctaatgtttgcctgcgctaatgccgagaagaaacgagcagcaatgcctttcgcttgcttcattccatcgcccacaacagaaataatggataagtctttaatcacttcaattggttctaattgatgttcatttaattcattagcaaactccgtttctagtacggttttcgctacttctgcagatttcacaggcacacagaaactaatactatattcagacgaagactgagtaattaaaataactgaaatgcctgcgcctgacatggctgaaaatacgcgagatgccatgcctaccataccttgcataccagggcctgacacattaaacatcgccaaattgtctaagttagtgatacctttaacttgcaaactttctgatttcacattgccatcaataatcgaacctggtgcagaaggatttcctgtatttttaatgacacaaggaatattttgtggcaacaatggcccaatcgtacgaggatgaatcactttcgcaccgaaataagagagttccatcgcttcacgataagaaagcgttggtaataaacgtgcatcaggcactaaacgcggatcgcaagtataaacgccgtccacatcggtccaaatttcgcatacacttgcgcctaaacaagcggctaaacaggcggcagaatagtctgagccattacgaccgagcaataccaactcgcctttttcattacccgcagtaaaacctgccatcagcaccactttatcttttgcgatatttgctgcatcaacacgttttgttgattcttcaatttcaacagaagattcaagataaccgccttttgccaataattgtttgacaggatccacaatatgtacgctatagccacgcgcttcaaaccaagctttcatcattgcaatagaaagtttttccccacggcaatcaatggtcgctttaactgcatcttctacttttcctgcctgacggatttcttctaataatcctttaatttgaacaaattcagcatcaataagtgctttggtaccatttaagtcgaattgattattttccgtatgtaagccgttgatgatgttatagaaaatttcgattgcttcgttgaaatgcgtatcggttgattgatttaatgctgctttttcagaaagggcgacgagatggttggttattttggctggtgcagataaaacacctgcagcctgctcttctaaatgagcttgctcgatcaatttcgccgcttgggaaaaacgttccggatttgcaagcgaagtgccgccaaatttaagtacgcgcataattggttctcctagatattgtgtttttaaatttataaaaaaacccgctattcagttgaatcgcgggttttctgtatcttgtttttgctgcactaacccgcaccattaatcataataatggtcatcataatggcggtaatcgtgctaatgattacggataaagtgcggttatttttcattgtgttttatcttgaaaaatgaatgcgtaaagaaataccgaaatttcccgagcttgtcaaacagaaagtgacaaatttttcagaaattttcttagtcaataaatttcgtgtaaactaaccgcacttttttataaaggaaaacctatgaatatccagcataatctcaacctaattcagcaaaaaattgaaacggcttgtaaagaagaaaatcgcaatcaaaataccgtaaaattacttgccgtatctaagaccaaacctatttctgctattctttcggcttatcaagcgggacaaacggcttttggggaaaattacgtgcaagagggggtagaaaagatccaatattttgaatcgcaaggaattaaccttgaatggcattttatcggcccattacaatcgaataaaacccgtctcgttgcagaacattttgattggatgcaaacgcttgatcgagcaaaaattgcagatcgtttaaatgaacaacgaccgaccaacaaggctccattgaatgtattgattcagattaatatcagcgatgaagaaagtaaatcaggtattcaacctgaggaaatgctaacactagcaaaacacatcgaaaatttaccgcacttatgcctacgtggcttaatggcaatacccgcaccaaccgacaacatcgcagaacaagaaaatgcatttagaaagatgttggagctgtttgaacaacttaaacaagtcttacccaatcaacaaattgatacactttctatgggaatgacggatgatatgccgagcgcaataaaatgcggttctacaatggtacgcattggcactgcgatttttggtgcgagaaattattcaacatcacaaaataaataatcatggaataaggcccgaatttaaaacaagccttatttcttaatgaaatttaaatgccagtactctcgccacattttgagcggtagaaattaaattttgttcgccttgtttgagaatatccgataaatcgccaagttggtgaataatagggaacaccgcatcaataccgtgatcaaacaccacatcataatcttcacgcaaacaccctgcgatggcgatcactggcttattgaactgttttgccgtacgtgccacaccaattggcgttttacccataatactttgtgcatctattcgcccttcacccgtaatcactacatcagcatcttttacatagtcaattaaatgtaaccggtctaacacaatttgtatgcctgctttcagttgtacgcttggtaataatagcaagccaccacccataccaccagcagcacctgcgccagcctgatcacgaatttgtttaccgcaatcgcgttcggcaatttcagcaaaatgcgaaagtgcagcatcaagttgtttcaccatttcaggcgttgcgcctttttgtggtccaaaaatggcagatgcaccacattcaccacagagcggattattcacatcgcacgctacttcaatgtgaacttgttgcaaacgtggatctaattgttgaacgtcaatcttcacaatatttgctagctctgctccaccaaaaccgataggcttatcttgcgaatctaaacattgcatccctagtgcttgcaacattcctacaccaccatcgttggttgcgctaccgccaatgccaagaatgaaactctctacgcctaaatctaatgccagtttaatcaactcccctgtgccgtaactggtggtaagcaagggattgcgtttttcaggcggaacaagatgtaaaccagaagctgctgccatttcgataatcgcggtttttccatctcccgataaaccgaagaaacttttcactttgtcacccaaaggcgcggtgacttcacattcaatgagcttgccttgcgtggcatccacaagggattgaactgtaccttcgcccccatctgccattggcaattttacatagtccgcatcggggaatacacgtttgaagcctgtttcaatggcggtagcgacttcaagtgcggtcaaactttctttaaaagaatcaggtgcaatcacaaatttcataacaactcctagaatttaaatacgccaaaaattaaggtagaaacgatggtcatcatcaaaccgaccgcactttcataaggaataagttttaaacgttctttgatatccatattcacactaccgcctgtggcatggaagaaagaaccatgtggcatatgatcaaatacggtcgcccctgcatgaatcattgctgcaccagcaagactgctaactccaagttctaacaaggtactactgaacacattggatgccaccgcagtacctgccgtggtagaagctgtcgctaaagacatcaacacccctgaaattggtgcaagaatgtatgatggcaaacctgaatgttccaaaccttgaatcaatacttcttttaaaccagaattagcaatgatgccagcaagcgcgcctgtaccaagtaacataattgccacgggtgtcattttactcaatccattgatagcataactatttatattgcgaagtttgcccatacaaaacgcaccaatcaaaccacctaacggcaatgcaattaatggatcaactttaatatcaaacaatggacgaagtgccaatagcaaaattgccactaaaggtgcgacaagtgcggtcagaaatgaaggtaaattttgcgtttcaagcacgattacctctttgtcagtcactttagaacctttgttgattaagcgttttgctaagaagtaggtgagaatcaaaccaaatagcgcgggaattataccagccatcatcacggaagtgagtggcaaatgaaaagtatctgctgccgcaatggcatttgggtttggcgacataatattaccagctttaccaccgccaatcatggcgagcaaaattgcagctttcgataaatcgctgcgacgcgataacgctaaagcaattggtgaaacagtaatcactgccacatccacgaacacacccaccgcagttaaaatcatcgtcgctagtgccaaggcgagtaaagctcgagtttcacccaatttattagtaatggtttccgtgatggaatttgctgcacccgattcaatcagcacaccggccaacacaccagcagctaagatacgcataaccgcagtagtaataccctgtgcgccaccgatcattaggctcactgtttgcgataaatccgcaccaccaattaagcctccaaccaaagctcccactaacataccataagctggtgagacttttttcaaaatgaggaagatagcaacgattaacgccaccaacgcacctattgctgagactgttgtcattttttctctcctataaaaattaaaaccaaggagattatttctgttttataggggaaatgctttattagagcaaacaaaaagtgcggttaaaaatcatcaaactttgtaaagttatacaacctcaatgttctaacaacgttccgagatagagcgttaatttatcatctatcttattgaaaaataagccagttatttgctctattttgttcaatcgataacgcaaagtattcgggtgaacaaataatttttccgcagtgagataaagatcacaatttgataaaaaatattgttgaagggttttataaagtatcgcatttycttctgagaaanggggagaaaggggttttatcaattcgttcccttgccaagaatgggataatccagcaagtaacacaggcaatcgatgctcatcaaacacataaatacctttgcgtggatgatgttttaatccataagaaagcgtgctttgcgcactttgaaaagacaagggaagctgctcaaaaagcggtagatttagacaagcgcctacagcaattttataatcttgttttgaataatctgcaggtaaaagcgttttcatttgagcagaaagtacggtggagttttgccaagtctttaagaccacaacctgatcaagggacaaaattgccacatcctgtgcaaattcagactgttccaaataattgatcagattctgtaaattatccagggctggattaagtaacttaatcaatacaaccacacgagatttatttaaatcaaaagaaaaaaatttcgcctgctgttccatctctttccaattcaaattgcaatgtaataattgtaaaataaattcttctttgtaacgacgatgccagctttcttgttcgagtaaagcctgttgttccacaataagttctgccgtcattttcactagttcggcatattgtttcacctgagttggctcaccagaaatccccaccactccaatatttttgcctaaataatgaatcggtaaattaatccctggttgtgcttcaaaattccatttttgtgccaacgcttgatcaatctctaccacacgattttcccgcaacgccaacaccgctcctgtgtgccgttgattcaaacgcgttgaatttcccgacgcaatgatcacaccgtcgtgatccattacatttacagagtgatgaatgatcttcattgcacgtttaacaatttttttggcagtgtatttgtcaagttgcatatttgtaataaagaagataaatgaagataaaatattgagaaaaagaaagttagtcaaatattgttttatctgcaagaaaagacgggagactattctcccgcactgcgtttttatcgctataatgttttattctgaacttgaacatatcccataattaatgccaaaatacctagtggaaaaatgagatctattacagaaccatcatttccccaaatcaagaatagctttgatgaaaataattaaaatcggtaagacaataggaatactcacgacatagcccgtaatggctaatgcccattcttcctttttcttacctagaaatttgataaagctgaacgccattttttcagcaactgggcagattgaagtttcaccatgtaaaggttctcgaataatgctacttacaaaggaagaagtcgctttatttggttttcctggacggatacaaattgtgggcaggcgaagacagagaccatcaacaaaaccttttcttgtatagtcattaataagtaattcactcattgctttttgtgcaccataagtcgattgtggcgttacagcagtagaatcctgaataatttctggtaaatcaccaccaaatacagcaagtgaactagaaaaataaaacgaattttagtatcagattcatcaaaatatgggaaagtggcgacattccatatttgtccactaacaaattttgatcacataatttgcgacaaaaatcttgttgaatctgcacagaatggcattagagaattaaatattaatttaactatcgtataaataaattaatataaatgatctgcaccccaaaactaaacaaataagcttactcattaaggtgcaaatcaaagtgcggttcatttttatattatttttggctacatacagcaataaaatgtaatttatgttcaggatcattaaaggttttgaacattcttttaaattgctcacgattttccgctttcatcgcattacggatgatttttaacgtaccgaaaattccttcatcataaatcattccttttggggaaagtaatgtcatctcaccagagaaagtatcaacatttctaaaaccactttcttggaatatgcctttccatccatctttcgttaatggcgtgacagtcacgttaatcgctttgcgcatattttctagaatagtttgatgatcattccccaccagcataacatcgtgagtaagcaataaaccattgggttttaacactcgaaaatattctgcaatggcttttttcttcgcttccacgggtaacattgtgagcatcgcttcattgatgacaatatcaaaactttcatcctcgaaaggcaacttcatcgcattcgcacgctgtacatgaattttttcctgcaagccatttgcttcaatatttgcttgtgcttttgctaacgcattttcatctaaatcaacaccttcaatatgacaaccaaattgtttcgccaatccaattgcagtcgtccccatattacaggcaacctccaacacttttttatcttggctaaaaccgccattagcaattaaccaatctgtcgcttttttaccgcctggacgcaaacgcgttttacccaaacgtgcaagaaaattatgccctacttcatcttttgccatttttatctcctagtaattaacttggtttttatattatagataaaaatgataactattaaaatgtcagatcaaataaatanggcggaataattgttccgccttttcctattatttcttcaatgcttttttcaattcaagtaattcacgacgtaactgtttcaattcgctttccatttcagcttgtttatacagttttttgtcggtttctgcttgttgagagcgcatcatcactacttcttgtcacaattgcaaaacttccgcagaattgaccgcactttgtgttgaaacttaatctctcaagcggtttattatccagatacgaaatttgttggtgtggatttagcggatagtcaaattacccaaggtaatgaaattattcaatcaatgggcttaacaaacgttcgtttgcttgaatattttatttatcaagttggttcatttactattcaatctttaacacagcatattgaggaaaataaagaatttgccaatattactgaaaatgaactgtattctgcggtgctatctttagttattttaggttatgtctatgtttatcttacgacctatccaatttattcctttgaagataacaaaacttacataccgaaaagctttactcaatatgtaaaaacattggtagaaggcgcaaatcagtatattggtgctggaaatatgtataacggcgacgtagaagatttgaataaactgcatctttatataatgtctcaaatggaaaaaccgacaactaaagctgaattgaaatcagcattacaaggctatttaattcaaaatgaatatcaagatatgaataacaatgataaattgattgatgaaacttatgattgcactgagttgtttaatgcgctttttgatgtattaacaagattaggtatatccagcctgtaaacctataatctgtgtatggttcgtttaatgtaccgttttgtttttcatctaaatatcaatttaaattgagaactatttgcatttaaataaaattaggcatagaatagccacaattcaggctgaactgaataatttgcactcaacataaggagcttttcaatgcaatttaaacatttcaaacttgctacccttgcggcacacttgctttttctgctaatagttttgctgatattaccgtttataatggtcagcacaaagaagccgctacggctgtggcaaaagcctttgaacaggaaacaggcattaaagttacgctaaatagcgggaaaagtgagcaacttgcaggtcaattaaaagaagaaggcgataaaacaccagccgatgttttctacactgaacaaacagcgacttttgccgatctttctgaagcagggcttttagcaccaatttcagaacaaaccattcaacaaaccgcacaaaaaggcgtaccacttgcaccgaaaaaagactggattgcattaagtggccgttctcgagtagtggtttacgatcacactaaattatctgaaaaagatatggaaaaatcagtgcttgattatgcaacaccaaaatggaaaggcaaaatcggttatgtatcaacttctggtgcgttcttagagcaagttgttgcgttaagcaaaatgaaaggggacaaagttgcgcttaattggttaaaaggtttaaaagagaacggaaaactttacgctaaaaatagtgtggcattacaagcggttgaaaatggcgaagtacctgctgcgttaatcaataactattattggtataacctagcaaaagaaaaaggcgtggaaaacctaaaaagccgtctttattttgttcgccaccaagatccaggtgcgttagttagctattcaggtgcagcagtattgaaagcctctaaaaatcaagctgaagcacaaaaattcgttgatttcttagcgagtaaaaaaggtcaagaagcattagtggcagcgcgtgcagaatatccgttacgtgctgatgtggtttcgccatttaatcttgaaccttatgaaaaattagaagcaccagtggtgtccgcaacaacagctcaagataaagaacatgcgatcaaattaattgaagaagctggattgaaataatccaaatattgcgtgcgtgtatttgaaaaaattcacgcacgcgtttacaattctctaacaaaattaaccgcttgcgtgcgtgaactgaaaagttcacattcctaaaaggatttaactttgcctcgcagaccgccattctggctcactttacttatcatcttaatcgggcttccgttatgtttgccgtttctgtatgtcattttgcgtgcgacagaagtgggattaacgcgaagtgttgagctattgtttcgccctcgaatggctgaattattaagcaatacaatgcttttaatggtttgtgtaactatcggtgctatttcacttggcacgttttgtgcttttttacttgaacgttatcgcttttycggtaaagctttttttgaagtggcaatgacgttacccctttgtattcccgcctttgtaagtggttttacttggntcagcctcacattccgcgttgaggttttttggggaacaattggtattatgacattaagttcatttcctttggcttatttgcccgtttccgccatactaaaaagacttgatcgttctcttgaagaagtaagcctttcgcttggtaaaagccctgtgtataccttttggtatgctatttccccgcaacttaaacccgccattggtagtagtatcttactgattgctttacatatgttggtcgaatttggtgcagtgtcaattttaaattatcaaacctttaccactgccattttccaagaatatgaaatgtcttttaacaacagcactgctgcattattatccgccgttttaatggcgatttgtatacttattgtttttggggaaattttctttcgtggaaaacaaaccctttaccacagtggaaaaggcgttactcgtccttatctcgtaaaaacactttcctttggaaaacaatgtttaaccttcggatttttctctagcatattcattttaagcattggcgtgcctgtgattatgttaatttactggcttattgtgggaacttcacttgaaagtgcgggtgatttttcagaatttttatcggcattcagcaattcatttatcatttcaggcttaggcgcattgcttaccgtaatgtgcgccttgccattagtttgggcagctgttcgttaccgtagttatttaacgatttggatcgaccgcttgccatatctattacacgctgtgccaggcttagtcattgccttatcattagtctatttttccatccattacgctaacgacctatatcaaaccttttttgtgattatcattgcctactttatgctctatttgccaatggcacaaactacattaagagcgtctttagagcaactttccgatcaaattgaaaaagtcggacaaagtcttgggcgaaaccctttctatatttttcgcaccttgacgctaccagccatattaccaggtgtggcagccgcatttgctttggtttttttgaatttaatgaaagagcttaccgcgacgcttttgctcacatcaaatgatattaaaaccttatccattgctgtgtgggaacataccagcgatgcacaatatgctgctgccaccccttatgcgttaatgctcgttcttttttcgggtattcctgtatttttattgaaaaaatatgcgtttaaataaaatgataaataatccgttattaaccgttaaaaatctcaataaattttttaatgaacaacaagttctgcacgatatttcattcagcttacaacgcggagaaatcctctttttacttggttcttcaggatgtggcaaaactacattattacgtgccattgcaggttttgaacaaccctctaatggcgaaatttggctaaaagagcggttaatttttggcgagaattttaatcttccaacgcaacaacgtcatctcggttatgtggtgcaagagggcgtactttttcctcacttaaatgtctatcgcaacattgcttacggattaggcaacggcaaaggaaaaaatagcgaagaaaaaacgcggattgaacaaataatgcaactaacgggtatttttgaactggcggatcgctttccacatcaactttcaggcggacaacaacaacgcgtagcattggcgcgtgctttagcccctaatccagaactgattttattagacgagcctttcagtgccttagacgagcatcttcgccaacaaattcgccaagagatgctccaagcacttcgccaaagcggtgcttccgcaattttcgttactcacgaccgtgatgaatccttacgctacgctgataaaatcgccattattcagcaaggtaaaattttacaaatcgatacacctcgcaccctttattggtcgcctaatcatcttgaaacagcaaaatttatgggggaaagtattgttttgcctgcaaatctactcgatgaaaataccgctcaatgccaattaggcaatattcctataaaaaataaatcaatctcacaaaatcaaggtaggattttgcttcgtccagaacaatttagcctgtttaaaacatcagaaaatccaaccgcactttttaatggacaaataaaacaaattgaatttaaaggnaaaattacctccattcaaattgaaattaatggctacgcaatatggattgagaacgttatttctcccgatttatctattggcgataatttgcctgtttatttacatagaaaagggcttttttactcctaagaataaagccttatcttcacgataaggcttatttttaaacaatatattcggaaaaaatttgttcaagatgtgatattaaacagtctgcgcctaaaatattttcccctttccacgcctgtggcaaaatctctggagaaaattgctggcttgccaattcagctaacggcaaataactgatatgccaaggctcccgccccactttcttattggactgcatattcataaaaggcaaagcaaaatcaaagtgcggtaaattttcggcaagaaattcactcaattcaaagaagtagccgcctttttcatattcccaaggctccagttgtaaagattgacctcgtggcaaaagatcaggatcaaaaatatccacttccgttccccaatgatgacgactagccgcagtaatgcagaccaacgtaaaatcgcctgacatttttgccagtcatctaattgattcaaatctaatgcctttcctgcatcatcgtgtacttttcgctcgcccttaaatttactgttccaaataagttgttggcgttcaaaatcacgaaaactgctcgcaggctgtaaattaaagccattttttgccgcactttgttgcaaagcttgaaatgcttgcacagcttgcgtttgcaaaaaatgatttgatgaatgagttgtgggtaaattgactaaatgctcacgggactttcctgtaagcatttctggggttaatttcattttagctatccaataaattcactaacattttgtggtaaatttcaccgcacttgccaaggtcttctacactgacacattcattgactttatgaatggttgaatttaacgggccaaattccactacttctgcgcccatcaatgcaataaaacgaccgtctgacgtgccgccacctgtttcagcctttggcgttatgcctatggtttcctcaatagcggaggttatcgaatctaataatttacctggttttgttaaaaagggtttgcctgataaattccattcaatacgatatttcaaattgtgtttttctagcatttcagccactttttgcttaatgatttcatccgtgacttctgtgcaataacgcaaattgaactgaatatataactcagcaggaattacattattacttcccgtacccgcgtgaatgttagcaatttgtaggcttgttggcgggaaaaattcattgcctttatcccattggtaagtcgttaattcttgcaaaaatagcgctgctttatggattgggttttcagctaaatgcggataggctacgtgtccttgaataccttgaatatagagatttcctgtaattgagccgcggcgaccatttttgacaacatctcctaagtttttagcactcgatggctcgccaaccatacaataagtaattttttcatcacgcgccattaacgtctcaaccacgtgtatagttccatcttttgcggtagcctcttcatcagaggtaatcaataatgcaatggtgcctttatgattaggatttgcttttacgtattcttctgccgccacaatcattgctgcaagggagcctttcatatccgccgcaccacgcccataaagcatgccatcaataatctccgcagaaaacggcggagacgaccattgattttcatcgccagtaggcacaacatccgtatgacctgcaaaagcaataactggctcgctcgttccgtgttttgcccacaaattcaacgtgtcattaaaaggcatccattcaatttgaaaacctaatttttctaaacgttcggcaataatttgctgacagccttcgtcatttgggctaatagacgggcgacgaattaaatcttgtgccaacgaaaccactttttctttcataaaaactcctaagaaaataaccgcactttaagcaaaagcagcctgatattccttttcattaaatccaattaatgcctttccatcttgtaaaataattgggcgtttaattaaagttggattctcagccaacacggaaagtgcggtggttttatcaagagaatttttaacttgctcatccaaattacgccaagttgtactgcgtttattcactaacacatcccagccaaattgagtttccgcttgggttaaaaaatttaaatctaacccatcaacacggtagtcgtgaagtttgtgttcgatattgtgatccgccagccatttcaacgctttctttactgtatcgcaatttttaatgccgtaaactgtaatcatatttcacctaaaaaagaaaaatcctcaatctaatcagactgaggattttaacccttatgctacttcatctcaaatgaattaacctaacaacttattgatacgtttaataaacgcagctggattttccaaagatccgcgctctgctaacatagcttgttcaagtaataattccacccaatcagcaaattcagtttcatctgcaatatcagccacttttttcactaaatggtgttctggattcagttcaaatgtgtattttacttctggtacaggttgccctgcggctgcaaacaatttcgccatttgggtcgtcatttgatcgttatccgtagaaaccaccgctggtgtatccgttaaattgtgagttaaacgcaccgttttcacacgttcgccaagcaagtttttcacacgctcaataaaactaccaaaggcttcatcttgttgtttttgtgtttcagattctttatccgctaaatcgcctaaatccaaatctgcttttgtaatactttgtaattgtttaccatcgaattcagttaaatagcttaacatccattcatcaatgcgatcggaaagcaacaaaacctcaatgccttttttattgaataattccaagtgcgggctatttttcgctgcaacataactatccgctgtaatgtaatagatagctttttgcccctctttcatacgcaagatgtaatcttctaaagagacagtttgctcgctaccatcattatgtgtcgaagcaaaacgcaataacttcgcgacagtttctttgttagcaaaatcttctgcagggccttcttttaagactaaaccaaactctttccagaattgaagatatttttctgcatcatcttttgctaatttttctagcatttgtaatgaacgcttagttaatgctttgcgtagtgcagccgtaattttgttatcctgtaaaatttcacgagatacatttaatggcaagtcattgctatcgattaaaccacgcataaaacgtagataattcggtataaattgctcagcatcatccataataaatacacgttgaacataaagttttaagccatgtttatgttctcgattaaataaatcccaaggtgctttagctggtacataaagcaaactagtatatgcttgatttccctcaactttgttatgcgcccaagtcacaggatcaacaaaatcatggcttaagtgtttgtaaaacgctttgtattcctcatcagacacatcatttttagaacgcgtccaaagggcatcagatttattgattttttcccatttttcgccgcactctttgccttcatcatcgtattctttcgtcagcatttccactggcaagccaatatggtcagaatatttaccaataatttcacgcaaacgccattcatttaaaaattctttttcatcttcacgtaaatgcaaaatcacatctgtaccacgggattttttctcaatatccgccacagaatattcgccttcacccgcagattcccaaagtacggctttatccgcctcttcaccagctgctctggtttttacagtcactttatctgccacaataaaagcagaataaaaacccacaccaaactgcccaataagctggctattttttgcttgatcttgaccaagtgcggttaaaaattcttttgttcctgattttgcaatcgtacccaaatgatcgatgacttgctcacgggtcatgccaatgccgttatcgctaattgtgatagtgcctttatccgcatcaaagctaacacgcacacgcaagtcgccatcgccttcatataaagcagggttggaaagtgctttaaagcgtaatttatctgccgcatcagaagcattagaaatcaattcacgtaagaaaatttctttgttagagtacaaagaatgaatcattaattggagtagttgtttgacttcagattggaatccgcgagtttcttgattttgtgacataattttttccttcataaagataaaaattgaacgtcacagatataagaataaaaagaaagatttcaagaggaatttaagaggaaaagtgcggtaaaaaaacacaaggaatttaaaccgcactttaaatgaaataaaaaatttcttatcccccttgatcgctataaatttatgtatataatgaattctgttttagatactagatagtaatttaatagtaatgaaacttggctagtgcattcccccactcctttcgcactagccatttttttgggaattttgtaccatatcccaactttttccaatcaacgatccattatgaataatcttgaacttgaacaactcattaatcaaaaactttcttctgataaaatcaatgactatgcgcccaacggcttacaagtcgaaggtaaaacagaaatcaaaaaaatcattactggcgtaacggcgagtcaggctttaatcaattacgcaatcagccaaaatgccgatgctattttagttcatcatggctatttttggaaaagtgaaaccccttgtatccgaggaatgaaaggcaagcgaattaaagcccttttagtgaacgacattaatttatatggctatcatttgccattagatgtgcacccagaattaggtaacaatgcacaattagccaaactgctcgatattgaaaatttacaaccattagaaaaaggctctgtgagtattcctgtttggggcgaattaaaagaaccgatgacaggtaaagactttgcagaaaaaatagaaaaagtgttaaatcgaaaaccgttaatttgcattgaaaacggaccgcacttaatccgaaaaattggcatctgtaccggtggcggacaaggttatattgatcttgctgcagaacaaggctgcgacgcatttattacaggggaagtgtcagaacaaacgattcattctgcccgtgagcaaggattgtatttcttctctgcaggtcatcacgcaacagaacgctatggcatcaaggcattaggcgaatggttggcgaaagaatatggctttgacgtagaatttaaagatatagataatccagcataaaatacaaaagtgcggtaaaaatatttcttttttaaccgcacttttatcttctgaaattatcgtttaaacattccgcctaaaccgccaagaccgcctaagcctccgcccattaagccttgcattccacgcatcattttagccatgccgcctttacgcattttcttcatcatacgttgcatttcatcgaattgtttaagtaatttattgacatcttgcacttgagtgccagagcctaatgcaatacgacgacggcgagatcctttgataatatctgggttggcacgttcttttagggtcatggagttaatgatcgcttccattttgacaaacattttgtcatctacttgatttttaacgtgctcagacaaattttttgcacctggtaatttctcaagcatagacatcatgccgcccatttttttcatttcgatcagctgttcgcggaaatcatctaaagtaaaatcatcgcctttcttgaatttctgcgccattttttccgctttttcacgatcaacagaacgttcaagatcttcgataagggaaagcacatcgcccatgcccaaaatacgggaagcgacacgatcaggatggaatggctcaagcgcctctgttttctcgcccacacccaagaatttgattggtttacctgtgatttgacgaatcgataacgccgcaccaccgcgcgcatcaccgtccactttcgtcaaaataacccctgtaagaggcaatgcttcattaaaggcttttgctgtatttgccgcatcttgaccagtcatcgcatcaacagtgaaaagagtttcgattggatttaatgcagcatggacttgcttgatttcgtccatcatttctgtatcaacgtgtaggcgacctgccgtatccacaatcaacacatcgtagaatttcagttttgcatcagcaagcgccgatttagcaatatcaacggggttttgtttaacatccgatggaaaaaaatccacgccaacggattgagccaaggtttcaagttgcttaatcgcagcagggcgatatacgtcagcagacaccactaacactttctttttatggcgttcacgcaagaattttgccaatttacccacactggtggttttacccgccccttgtaaacccgccattaagataactgctggtggttgggttgcgagatttaaactctcattcgcttcgcccatggctttttcaagctcacgctgaacgatttttaagaattcttgccctggcgttaaacttttattgacttcttccccaagcgcgctttcttttacttttgcgataaattcacgcaccacaggcaaggcaacatcggcttcaagtaatgccatacgcacttcgcgtaaggtttctttaatattatcttccgttaaacggccttttcctgtgatattacgtaaggttttggaaaggcgatccgataaattctcaaacatggctaacaatcctgtttttcttaaaaaattgtgctgattataccgaaatttaggcgtttttcatcatttcaaatgaaaatgactttttgagtaggcgatttcataaagaaagtataggacataaggaaaaagaatgattatttagccaatttcaggtattattctgcccactcttagctatttgagcagctatttgatttagcaaaatcaaataacaggtaaaaagtgcggtgaaaaatgaccgcactttttgttgattaacgaacaaaaggattttcccttggatagcattccccttagtactttatttattattcttattatctgtttagtgttatcagcctatttttctggttctgaaactggattactctccctcaataaatatcgtcttcgttttctatctgaacaaggcaataaaggcgcgaaaaaagcggaaaaactgctagaaaagccagataccttgttaagttttattcttatttttaataaccttgtgaatatcagcgcatctgcaattgcaacagtaattggtatgcgtttatatggcgatgccggcgtggcgattgcaacgggtttgctcactttcgtaatgctcgtattttctgaaatattccccaaaactgtggctgcaatgcacgcagaaaaagtgagttttttttcaagtcatattttaacttcattgcttaaaatcttttatccgctcgtttggttaatgaatatttttactaaatccttgatgcaaatagtagggttaaaacttgatatgcaaaaacaagtaattagtagtgaagaactgcgtagtattgtatcagaagcgggcgaagcaacaccaaatgaacaacatccacaaatgttgctgtctattttggatatggaaaccgtcaccgttgatgacattatggttccccgcaacgaaatcggcggtataaatattgatgatgattggcgagccattatgcgccactcaatcatgctgcacataaccgcgtggtgctttacaaaggcagccttgatgaacaagtgcttggcattttgcgcgtgcgtgaagcattccgcttgctccttgaaaaaaatgaatttaccaaagaaaccttaattcgtgccgcagatgaagtgtatttcattcctgaaagcacgccattaaaaacgcaacttgcaaatttccgtacaaataaagagcgaattggcttagttgtagatgaatacggcgatattaaagggcttgtgacgttggaagatattttggaagaaattgttggggattttaccacttccaccgccccaagcattgacaaagaagtaattcaacagtctgatggttcaatgattatcgatggctccgctaatctacgcgatctcaacaaaatgtttaactgggaattagatacagaagatgctcgtacttttaatggtttaatcttagaacacttagaggaaatacccgatgaaggcacgatttgcgaaattgatggtttgctaatcactattcttgaagtgggcgataatatgataaaacaggcgaaagtcgtcaaactttaatcataaaaaactccaccaaattgaaccgcacttttgacttggatcataagtgcggttctttttttgcgcattttttagaaaagatttttataattctttctaggtatattttgatagaaaagaaagatatggaacacgaatatcaacgggcggtgactcgcgtgtgcgtacaaacggcactgctcttgttacaacatggggcagaaagtaccgtggtggtacaaatggcacagcgtttaggcgtagcacttggcgtagaaagtgtagaatgtgcgcttacggcaaatgcagttgtgctgacgaccttatcagataatcattgcattactaccgcacgaaaaaatacagataaaggcattaatatgcaaatggttactgatgttcaacgcattgtgattgccgttgagcatcatttgtatgagttagagatcgcacaaagaaaactggatcaattaaaaccgcttaaatataaccgatggttagttgtattcatgattggcttatcttgtgcagcattcgcccatttatctagtggcgattggataatttgcggcatcacaatatttatgttgaaattactctatgatatgctatttgctgcgattccagcggtgggctttgctttagtatttaatgtaccgcccaaagccttaaaatattgtgcaattttagccgcacttgggcatgttacacgcacattattactgcatattaatatgcctattgtatttgctacattctttgccacttgcgtgattggatttttaggcgtgcatctttcccatcgttatttagcccatcccaaagccttcaccgttgccgcaattatccccatgatccccggtgttcatgcttataaagcaatgatttcaatggtacaaattcatcattttggcttttctgatgctttatttgaacagatgattagctcctttattaataccagttttatcctaggcgcaatagtatttggattggctttaccaggcttattgttttatcgacaaaaacctgtggtgtaacactaaaaacagtgcaacaaaaaagccgacatttgtcggtttctactattcttgtgattttttcttgaggtattcataaagctcatctttaatccgtaattttccttttttcaaataacgatttccattttgtaatcaattcattatttaatgtttggcgcacttgattattcacataacgaatgtattccacaaaaagttgatccacttcttcacgatcaaaagaggatagaattaattgattaagattattttcttgagaaaacttaaaatgtgaggcaatttgctgaacagtttcattttcaactttagctctcgctttcacaaaatcagattgatttaaaaaagccattaattgagcggatgaagtaagaatttttgtaaattcatgatacgcagaatctgtcgccttacgctcaatttttaccatatcaacggcatcagcatcaccactaactaaatggggcgtggattctaatacaaagtgcggtcaattttnctttatttttatacgttggcttttaaactggtttatttgaagaaagcacgctagaataaggttgttttcatttcaacgaaaaaagtaaggaaattctatgatcgatccaaatttactccgtaataatttagcagaagtcgcagaaaaattaaaagtaaaacgcaactttatgcttgatacggaaaaactcaccgcgttagaagatcagcgcaaaaacttacaagtcactaccgaaaacttacaagcggaacgtaatgctcgttccaaagccattggtgctgctaaagcgcgtggtgaagatatcgcaccattattggcagaaatggatgatatgggcaatcaattgactgaagcaaaagcacaattagatgcggtacttgcagaaatcaatcaaattgcattaagtattccaaatctacccgcagacgaagtgccattaggcaaagatgacacagaaaataaagaaatcttacgttggggtacaccgcgtacatttgattttgaagtgaaagatcatatcactttgggtgaagaagcaaatggcttagattttgctgctggggctaaattagctggtgcacgttttgccgtaatgaaaggtcaaatcgctaaaatgcaccgtgcattggcacaattcatgttagatcttcatacggaacaacacggctatttagaaacctatgtgccttatttagtaaatcacgccacactttatggaacagggcaattaccaaaattcggggaagatttattccatactttagccttagaaggcgaacaaccttacgcattaattccaactgcagaagtgcccgtcactaatttagtgcgtgacgtgattattgatgaagcagaattaccaataaaaatgaccgcacatacgccatgtttccgttctgaagcaggttcttacggtcgtgatactcgtggtttaattcgtatgcaccaatttgataaagtagaaatggtacaaatcgttgatccagataaatcaatggaagcacttgaagaattaacaggtcatgcggaaaaagtattgcaattattaaatttaccataccgtaaagttttactttgcacaggcgatatgggctttggttcttgcaaaacttacgatttagaagtttgggtgcctgcacaaaatacttatcgagaaatttcttcttgctcaaatatgtgggatttccaagctcgccgtatgcaagcacgttgtaaagcaaaaggcgataagaaaactcgcttagtgcacacattaaatggttcaggcttagcggttggtcgtactttagtggctgtacttgaaaactatcaaaatgccgatggttcaattaccgtgccagaagagctacgtccatatatgggcggattagacgttatcggaaaataatccttctagaagataaaaaagcgtggattttaaaatttccacgcttttttattatcaaagccttacaataactgttttaaattttttggtattcaagccaattaggaactttattctattataaaattatatctataacatagaaaatttatctttcaattgacatcaatatccagaacattactctaaaaaacatatcaaagtatctaaattgttataatattagttcactttacgattaaacaatagtaagaagcaattttaataagttagatattccacgtataaaacagtataattccatcaatagctcataaaccaacaggagtattttatgaaattatatggtttaattggtgcgtgttcatttgttccacatgtggcattagagtgggtaaaaatacgtgaaaatgctgattatgaatttgaacctgtcactcgtgagttaattaaatcacctgaatttttatcattgaatccacgcggggcagtacctgtattagttgatggcgatttagttctttcgcagaaccaagcgattttgcactatttagatgaactttatcctaattcaaaattatttggtagcaaaaccgtacgtgataaagccaaagcagctcgctggttagcattttttaattccgatgtgcataaatcatttgtgcctctgttccgtttgccaaactatgcaaaagataacgaaacacttgcacacactattcgccaacaagcagtagagcaaattttagatcaacttgcagtcgcaaatgagcatttagaaagtcacatttattttggagaaaatatttccgttgcagatgcctatctttacattatgctaaactggtgcaaagcagtcaaaattgatttcagccacttaacacaactttcggcttttatgcaacgtgttgagactgatcaagctgtcgaaaatgtgagaaaaagtgaagaactaaaagtataaacaggaagtttctacaaaaattgcccgtttttaaccgtttgtatcacgttaagtttaaatttaagtgagtaatttcgcgtcttacccaacacagctaacccattgattctactatgattaaactggttaatccaatgtcgcaatgttctactgtcaagttgaaaatgtttactgatgagtgaataatttttaccattttgaatataaaattcgatgacttgttgtttgaaaagagtgttgtatttggctataaaaaatctgcntcttacaattaatttatataagtaaaaatatcttgcttttatcatcgttaaacttagaataaatataaataattatcattaagatttaagggtatatatgaatattttaattaataaacgtatctttttattagttacccttgtaggtattcaactaaatgtaaccgcaaaacnaaattcttctaattctaatagagaggagttattacctattattgtgaacactaatgatgatagtaataaactacctggtcgttcagtattaaaacagaaaaatatcgaacaacnacaagcggataatgcagcaaatttaattaatatcttgccaggtgtgaatatggctggcgggtttcgccctggtgggcaaacattaaatattaatggaatgggtgatgctgaagatgttagagtgcagttagatggggctacaaaaagttttgaaaaataccaacagggttctatttttattgagcctgaattattaagaagagtaacagtagacaaaggaaattattctcctcaatatggtaatggtggttttgctggaacagtaaaatttgaaactaaggatgctagggatttcttgcaagaaaaccagaaaataggtggttttttaaagtatggaaataatagcaataataaccaaaaaacttatagtactgcactagttttacaaaatgaacaaaaaaatattgatttattactatttggttctgtaagaaatgctggcgattataaaagacccgataatagcaaaattcttttttcaaaaaataatcaaaaaaccggattaataaaattaaattggcaaatttcacccgagcatttactcacattatcgagtgtttatggtattcataaaggctgggagcctttcgcagcgaaaagagatatcctacctaaaccaagtttgagtgatataatgcgttatggtactgatatagcgtggaaacgtaaactggtttatcgagatcaaaaagatgaaaattacacattaaaatacaactatctacctgaaaataacccatggattaacttatctactcagttcagctacagtaaaaccacacaaaatgatatgcgtcccaaagaagcatcttcaggattagtgggtagcttaggtaatcaaagctggataacttattcagatcttacttttgatataaataacacaagtacttttaatatcaaaactactgttcatgaactattatttggtttgcaatggttaaaaaacacaagaaatactttaatgtatgataaaagtaaagtgagaaaagcggattataattatggctatttccaaccctattatatgccatctggacgtcaatatacacaggcgttttatttacaagatcaaataaaatggaagaatataatttttagcacaggagtgcgttatgaccatatcaataatatagggcagaaaaatttagcactaaaatataatgatatctctgcaggacatgattatagccagaaaaattataatggttggtcttattatttaggtttaaattatgatgtaaaccattatttaagtttatttacgaattttagtaaaacttggcgagcacctgttattgatgancagtatgagacgcaatttaagcaatcttctgtgcctgcaacctctttaaatttagaaaaagaaatgattaatcaaacgagagtgggtggaattattactctcaatcatctatttcaggaaaatgatgcttttcaatttagaactacttatttttacaatcgcggcaagaatgaaatatttaaaaccagaggagttaattgtgtaggcaatgctgcagataccaataataaggtttgtcctaaaatcattgaaaattatcgtaatttgccaggttatgttattcaaggtgcagagttagaagcttattatcaatctacttatttatttggtgagataacatattcttatgtaaaaggaaaacgtgacacctcaccaagaaacccatggggtaaaacctcaacatggattgctgaaattccccctagaaaagcaactactgctttaggtttcaatgttccaaaatattatctcacagtaggttggcgtgctgagtttgtaagaagacaagatcgatcgccattatctggtgatcctaaagcatcatcttggtcattgccagcttcaagaggatacagcctacataacctattcctttcttggagccctgcaaaaattaaaggtatgaatgttaagattacagtggataatttattcaatcgagcatacaacccttatctaggcgaattggcttctggaacaggtaggaatatcaaatttagcctatctcagaaattttagaataaatagcccgattgaatctaatcgggctttatcataactataattagatcataaaaaaatgtagagataataaatataattncctatactaattttagtattctttaaagagcaaatttaaataataaatccaaataagtacgacatcttaaattatagataaatatcaaaattatgttttatctttaccctattactttccataatagaaactaaacttacctaaaaatttaaatataatttagcatctngcttaacaacaaagtcaatacacatttcttctagttttcctttctttccgattaatataccccaaactatatagcctgttgttctcactaactttcctactataggaatatcattagcataagctatgaagaagaaagttaaaacagaggcattatgtaatataagttatttatataatttaacataactttccatataacaacaacgcatctttataacataattgcaatgtattctgttttaaatttatagcaattacctaaatagtaaagagtacgaataaagtacatataggctattaattactttaaaaaaaattaaaatatatttgtagatttatggacaattacatttatcctttaaaaggtagttaatctagagaaattttttatagcaatacaacaagtttacaaggaattcaaatatttttaatttttagaaaaaaacaaaaaccctagcttttcaactagggttctgtttttatgtgatttagatttgtatctgataacctggcggtgccctactctcacatggggaaaccccacactaccatcggcattacagcgtttcacttctgagttcggtatggtctcaggtgggtccaccgcactatcgccgccaggataattctttgataactcgtcttttctcttttatctctcgtctcttttatctctcgttactcagtctttcctcttacctttcactcgttcttattggtcacaagctgaatccgattttctttctattaagtcttctatatttacttttctttgtttagtcttttacttctctttcgctctgcttttatttgcttcgcttttcatctcttacttcacttagctcccaaaaacacttgagcgttgtatagttaagcctctcgggcaattagtattggttagctcaatgactcacatcacttacacacccaacctatctacgtcgtagtctacaacaacccttactgacttaaagtcagggatgactcatctcttggcaagtttcgtgcttagatgctttcagcacttatctcttccgcatttagctacccggcaatgcgtctggcgacacaaccggaacaccagtgatgcgtccactccggtcctctcgtactaggagcagccccaatcaatcatcctacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctctttcgatgacaccatcaattaaccttccagcaccgggcaggcatcacaccctatacgtccactttcgtgtttgcagagtgctgtgtttttaataaacagttgcagccagctggtatcttcgaccggttcaaccttcaggggctagcccttacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagcccacctctcgatgaaccttcttccgcttacacaacgctcccctacccaacagaataaattctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaagccgggatggccccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactattcgcccagttaagactcggtttcccttcggctcccctattcggttaacctcgctacaaaatataagtcgctgacccattatacaaaaggtacgcagtcacaaggttgccctcgctcccactgcttgtacgtacaaggtttcaggttctatttcactcccctcaccggggttcttttcgcctttccttcacagtactggttcactatcggtcaatcaggagtatttagccttggaggatgggccccccttcttcaaacaggatatcacgtgtcccgccctacttctcgttagcttagtaccacaatatggtttttagatacgggattatcaccctctttgattgtgcttcccaacacattctcctcactatattgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagatttttttacaaaacaggttttgtttttagagtttccttttcagttctctctttcactttactgttttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtactattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctataaataaaatactacttaaaaaagtaataatgaattttcagttaagcacctattaagacttcaaaattaaaaatagttttaaaacaagtcaatcaacaagtgcccacacagattgtctgatatattgttaaagagcaaaataaagtggtcggcgagataggatttgaacctacgacccactggtcccaaaccagttgcgctaccaagctgcgctactcgccgtcagatcttataaagataagatggggtggctaatgggattcgaacccacgacaactggaatcacaatccagggctctaccaactgagctatagccaccattaaaagttgttactgcattgacctggcgcgctcgacaagattcgaacttgcgacctttggctccggaggccaacgctctatccaactgagctacgaacgcgttactgcgtcgttgcggaggcgtatattaatgatttaataaaaccttgtctagcactttttgaaaaaaaatgtttgagcgatagttttttattcagtttgtttaaaatacactattttttcgactatttttacaacttggcgaatcattatatatgtggaatcatccaacaattatgaatttgtttattacgttcaaaatctagcggtaacgttttatgcgaaatttctattgcacttaagcctaattcttccaacgcaactaaattcattttgaatccacgtttattattcgaaaaaacaattgtgccattattcgacaaaactcgttttaaattgcgcattaatttcacatgatctcgttgcacatcccaactctcttccatacgtttagaattcgaaaacgtcggtggatccgcaaatatcaaatcaaattgacgatcacatttttctaaccattgaaggcaatctgcttgaattaatttatgtggtttaccttcaatatcattcaaaataagattttgctccgcccaattaagataagtatttgacatatcaactgtagttgtcgatttagcgccaccaagtgctgcatgaacagtggcagaacctgtataagcaaataagttcaagaaatctttaccctttgccaactcaccaatcatttttcttgttaaacggtgatctaagaataatccagtgtctaaataatctgtcaaatttacccaaagttgcgtgccatattcattcacataaaagtattcgcctttattggctaacttctcatattgatttgtacctttttgtttctgacgaactttgaggatcaacttattcgtttccacacctgtcacttgcaaagttgcagtaacggcatctaacaaacgctgacgagctttattttcatcaatatttttcggcgctgcatactcttgcacaacaatgtaatctgcataacgatcaacagctaaattatattctggcaaatcagcatcatataaacgataagcgtctaattcttgttgctttgcccatttgctaattttcttaatatttttttgtaatcgattagcaaaatcgggggcgacctccgaagtgcggttaaattctagttccttttcatctgtaattgcgtcagattttcgttctgaaacttgataattcttttgcacacaatctagtgggccattttttgctttaaactgtcggctggcacgcattctcaaacaatcaagcaatgtggattcgctactaaaaacagaaacattccaaccgcaaaattcttttttaagtctttgcccaaatacagaatagagcgcgattaaagctggtgttgttcctaaacgttcgccataaggtggattacagataaccgtaccgacttcatttaaacgaggattttttaacgctgccacatcagcttgctgccatttaattaaatgtgaaacacctgcattttgtgcatttttctgcgccttttttaatacgcggtgatcgaggtcaaatccataaaagtgcggttgaatttcacgttgtttttcttctgctaattcaatcgcttcattttttactttttcccaagccgattgattatgcgctttccaaaaatcaaatccccaatgtaaacgataaagttgcggcgcaattttggcttccatttgtgccgcttcaattaaaagcgtacctgaaccacacattggatctactaatggagaacccacttgccaacctgaacgcattaacaattgccgccgcgagagtttcacgtaaaggcgcttgacctgcatcttcacgatagcctcgcaaatgtaatgcttccccacttaaatctaaagaaatcactaaattttcacgattcaaataagcatggatacgtacgtctggctgaattttatctacatcaggacgagttttaccttgacgttcaaagtaatcgacaattccatctttaacgcgcatcgcaccaaattgagtatgacgaatttcttggttggttccattaaaatcgacaaagaatgtcactcgttcatcaaattgtgctaaccaattaaagcctgaaacagccgcataaagatccaaatcactgtaaattttggtttcaatcaaaggaaataaaatgcgtgaagcaaggcgtgaccaaagcaaagtgcggtataaagtttcgtcatcagcttgataatgaacgccaccttgaaccacttttgcctcttgcgcacccagttcagtgagttcaacttttaataattcttcaaagccacgagaagtcgttgcaaataattgtttcatttaggtaccgattttgaaaattttgagggattatagcatagaaaaagatgatctaattgagatcatcatagcgagttaaactgtaaaaagaaaagccctgattttcttaaatcagggctttagaatttgttggttgcgggggccggatttgaaccgacggccttcgggttatgagcccgacgagctaccaagctgctccaccccgcgtctgatggggcgtactatactcgcttaaaattgaattgcaagaattaaacaaaacttgatgtattgtttgttaataaaatgttcaatatgtggttttattaatcaacttcgctaaataacactggttgttttcagtaaattttgatagcgtatgcagccctattgtrgcttactttagaattaaaaaatgtcgatgcttaaacctttctggttcaaaactttttctatctcaattattaccgcacttttggtagcttgtacctctaacacaanaaacactcagattccaaccncctcaaatgggagtgatcctcaacaattcggtgtgcaaaatataccaatcgaacttatcagcaaaccgctcttgtgcctgtttcctatatagaaaaccaaagtgcggtaataaatcaaggcgattttttaacacagctttccaatataaaaaattattcaagtaaactttccacaaatttttacgataattatgaaaagaattacaaattgggttctttctggggcaaatattaatgaactcactcaatttaatatccaaccacaaattatgcgtggctttgatggatttcaaaatgtgctgatgacaggctattattcgcctatactttatgctcgtcattccccacaaggtcaatttaaaaatccaatttatcgtatgcctgtaaaaaaacgtctaagtcgagcacaaatttatgcgggagcattagcggaaaaagattagagttagcatatagcgattcaatgttagaaaactttttacttggtgtacaaggcagtggctatgtagattttggcgatggcaatcttaactattttgcttacgcaggacaaaatggttacccttacacggctatcgggcgtttattagtagaagatggcgaaattccaaaagaaaaaatgtctattcaagcaattcgagaatggggtaatcgtaatccctctcgtatacaaagcttgttagaacgcaatgaagcttatgtattctttaaaaatgatccaagtggcaaagtgaaaggctctgcgggcgttcctcttgtagcaatggcttcagtggcatcagatcgcaatattatcccatctggttctgtgcttttagtcgaagtacccgacattgataataacggaaactggcttggcacacacaaattacacttaatggttgcacttgatgtaggcggtgcagtgaaaggtcatcactttgacttatatcgtggtatcggtgctagagcaggacatattgcagggctttcaaaacactacggtagagtatgggtattacggtaatggctagaatagataattacgaacaacgctttggtggcattggacgactttatacgcctgatagcttagcacgcttacgccaagcgcatatttgcgtaataggcattggtggcgtgggttcttgggtcgtggaggccttagcacgatctggcattggcgaactcacattaattgatatggatgatatttgcgtcacaaatatcaatcgccaacttcctgcgatgagcggcacaatcggcaaattaaaaactgaagtcatgtcagagcgagtaaaattaattaacccagaatgtaccgtcaatattattgatgattttatctcgccagagaatcaatcggattatctcaaccgaggctatgactacgtcattgatgccattgacaatgtgaaaactaaagcgtcgctgattgcttattgtaaacgtaacaaaattaatgtgattactattggcggtgctggcggtcaaactgatccaacccaaattcaaattgccgatctcagtaaaaccattcaagatccgctgctcgccaaagtgcggtcagttttacgcaaggattacaattttagccaaaatccaaagcgtaaatttagtatcgatgcggtattttcaacacaacctttaatattcccacaaatgactgaaggctgttctacttctgccacaatgaattgcgcaaatgggtttggcgcagccacaatgattacggcaacctttggtttttttgccgtttctcgtgtaatagataaattactaaagaaaaaatcttaatcacctcttgaaaatgcacattgaccataaatgtgcattttttattgaatgaaacctattgactttgaaaatgaaaaattttccctctttttactataaaatcgttgcaatttatataaaaaggcgtactcttttttccctttgagaattactaccaacaagtaaggaaacataaatatgaaaaaacttttaaaaattagtgccatttctgccgcacttttaagtgcgccaatgatggcgaatgccgatgtattagcatcagtaaaacctttaggctttattgtttcatctattgcagatggcgtaactggtacacaagtccttgttcctgctggcgcctctccgcatgattacaatttgaaattatctgatattcaaaaagtaaaatctgcagatttagttgtatggattggtgaagacattgattcattcttagacaaaccaattagccaaattgaacgtaaaaaagtgattaccattgccgatcttgcggatgtaaaacctttattaagtaaagctcaccatgagcatttccatgaagatggcgatcatgatcatgaccataagcacgaacacaaacatgatcataaacacgaccatgaccatgatcatgatcataaacacgagcataaacacgaccacgaacatcatgatcacgatcatcacgagggtttaacaacaaactggcacgtttggtattctccagctatcagcaaaattgttgcacaaaaagtagcggataaattaactgcacaattcccagataaaaaagcgttaattgcacaaaatctttcagattttaaccgcactttggcagaacaaagtgaaaaaattacggcacaacttgcaaatgttaaagataaaggtttctacgttttccacgatgcttatggttatttcaacgatgcttatggtttaaaacaaacgggttactttaccatcaatccattagtggcaccgggtgcaaaaactttagcgcacattaaagaagaaattgatgaacataaagtaaattgcttattcgcagagcctcaatttacgccaaaagtgattgagtctttagcgaaaaatactaaagtcaatgtaggacaactcgacccaattggcgataaagttactttaggtaaaaattcttatgcaacattcttgcaatctactgcagatagctacatggaatgtttagctaaataaacctttctaaaaacaatgaccgcacataaaagtgcggtcatttttttttctaaatttgatatttagttttatctccaatatcaaaatgcaaaggcattcgccatttttgtatcgctaaaactaaaagtaatacgccagaaataatagaaaaaatgcgtagtgcaataagattatttaacacccacgaaaaccacaagcaagccacaaatatcggctgtaaatttagcaaaggcacgcggaaacaaaaatattctttaaaacacaaaccacctaaagtaagtaacgcaccgccaagagccaacgcaggataatgattaatataaaaaagtagtccaatccaagttgcaaattgaaaaagcaatcgaaaagattttaagtaaatgtgtaacgaagaggcacaacaggttgccgcaattaatataaatgtgagtgataaatctggataccaactcactgtaagaacagccaacgccgctatcacaaaaccagttcggtaaataataacagtcagataatctaaaaaatccatcggtgatttaatatgtggatcagccattgtataaatgttcctttttatgaattacaaattaaaaataaatatatcctaaaagtcagaaataaaaagtacagtcaatttaaaaacaggttctaaattaaccgcacttttattatttcagttttagcttatcaagaattttttgatgaatgccaccaaaactgccgttagacatcactaaaatatgatccgtaggttgagcctttgcaacaatcatatccactaatcgatctaaatttgcattccaataagcaggttgtacacattggtttgcaatatctgccacttcccaagaaagttgttcaggttgaagcataaacacggcatcagctcgaccaagtgcaggcgcgatgtcatctttatgaacacccattttcattgtgttagaacgaggttcaagcactgcaagaatacgaacaccaccaccaactttatctcgtaaagcggttagcgtagcaagaatagcttctggatgatgcgcaaaatcatcataaaccgtaatgctattaacttcgcctttcacttctaaacgacgtttagcattcacaaaagatcccaacgctttgcacgcatcttcaatagcaacgccagtatgatgagcggcagctattgccattaacgcattatgcatattatgttgtcccactacattccattttacttctgccactttttctccatgatggaaaaccgcaaaatgtgaagcatcatttgtaatacgttcagcaaaccactcgttatctttgcctaaaaattgctgttgagaccaacatcccaatgccaaagtttcttttgcactttgttcactcgccgaacttaataccaagccactggctgggatagttcgaatcatatgatgaaattggcgttggatcgctttgagatcatcaaaaatatcagcgtgatcaaaactaatattgtttacgataagtgtacgtggattgtaatggacaaatttcgaacgtttatcaaagaaagctgtatcatattcatcagcttcaataataaaataagggctatctcctaaacgagctgaaatgccaaaattacccgcaattccgccgattaaaaaacctgattttaagccattttgttctaagacccacgttagcatacctgtggtcgttgtttttccatgcgtacctgaaaccgccaatacccaacgatcgcgcaataaatgatcatgtaaccattgagggccagatgtgtatttcaaattattttccaacacatattctacgcaaggattaccacgtttcatcgcattaccaacaattaccatatcaggcgcaggttgtaattgtgcaacatcataatttggaataatctcgataccttgctcttctaaaaaagtgctcattggagggtaaacattagtatcggaacccgttacgtgatagcccatttgtttagcaatcatcgccacaccgcccataaatgtgccacaaatacctaagatatgaatatgtttcattgtatttctctgttgattaaggaaaacgaaaaatatgataaaacaacttctatgaactttcaaaagaaaagaccatcataccaaactatatgatctataattaacgccactgaactattatttaaccacttcaataggaataaacaatgaaatttaagcgataaagcaatttcagaagcacaatggctcactatttacaaagaaaataatcagccgttctatgtagcaaatcttcctgcattacaatttggaaaaagtattcaagtcgatattattgggacttcaattcattttgctgacggtacccaaattggtttagtttcagaacaaaaataatcctataaaaaatgcctgtgtaaaacaggcatttttttatccgcacttttaagcaattcgctcaaaaccagctttcaaatctgcaattagttcatccacattttcaaaaccaatatgcacacgaattaatgaacctgtaagattacgtttaatatttggacgaatatgtgcaatttcttctggttgattacaaagaattagagactcaaatcctccccatgaataagccatagcgaacagttgaaaatgatccataaattttgatacttgctctgaagttaatcgctgggttaattcaaaagaaaataaaccactgcttccactaaaatcacgtaaaaagaattcatgaccagggcaacttggtaaagctggatggtacacagtttttacttctggttgctcactcaaccattttgccactttaatactgctttcctgatgttgttttaatcgtacccccaatgtacggataccacgagcagtcgtataagcggaatctgcatcaaccatttgccccattaaataggaatgttctctaagttgatcccaagttcgcgcattcgcaacggcagtaccaatcataatatctgaatgacccactaaatatttcgtacccgcctgaatagaaatatcaatatcatgctctaacgctttaaatagaacacctgccgaccaagtattatcaatcataatcacaatattagggttcacctttcttgcagccttcacaatagtcggaatatcgggaatttccattgtaatagaactcggtgcttctaagaaaagtacttttgtattcggttgaataagcgttgcaatatcttcaccaataagaggatcgtaataagttatatcgatctgcatttttttcagcacaatattacagaaatattgggttggctcgtaagctgcgccactcattagcacatgatcgccagttttaacaaaagaaagaatcgaattagttactgctgctgtaccacaaggataaagataacaacctgcccccccctccatttcgcacattaaatcttgtaaagcaaaatgtgttagcgtccctcttctgccataaaataattcgccttttgctctacgttgagtagcgtgttttttatcttcaatactgtcaaatagtaatgaagaagctcgctgtaaaacagggtttaccgatccttgtgaaaaacgtttttgacgaccagaatgaataaacattgttgaaagatcatattttgtttgcatatatttccttatttaaattaacttatagggcaaaaataactatggtttcaattcctatccgcacctgattttacttcatctgcggtattaggcaatggaaaaaataaagagaaaacaacaaataattctgacgtctacacagaatccctaaaatagatgctaacgagctttaattttatcaattatttataaaaagcgaccttaggtggctttttttatcatcagagataatttagaataaaccatctttagctaaagtgcggtcaatttttctatgaaattcaatatcccaattttcctaacgatctttcgagtcattttgattccttttttcgtgattgcattttatttacccattgaatcatctcctttcatcacaacgctcattttttttattgcaggtgtcactgactggctagatggctatctagctcgtaaatggaaacagaccacgcgctttggtgcatttcttgatcctgttgctgataaagtaatggtagtggctgcactagttttaattgtcgaacatcaacatacattttggataaccattcctgccattattatgatttctcgtgaaattatcatctccgcattacgtgaatggatggcagagcttggggaacgtagcaaaatcgcagtctcttggtggggaaaatggaaaaccacagcgcaaatgttagcactaggcggattattatggcgttataacaactatatggaaatagcagcaattatcttactttatatcgccgctattttaactatatggtcaatgatccaatatttacaagtagcaaaaggaagcttgctagataatattcaattataaatttaaataaaacacagttattttttatgataaccatctatatttgagttatttttaatcaaataaaatattttttatttttttcgtttgacagcaatatataaatccgtaaaatacgccccgttgtcacgcagtagtgctgattagtgataaatgcgggaatagctcagttggtagagcacgaccttgccaaggtcggggtcgcgagttcgagcctcgtttcccgctccaatttgcccgagtggtggaatcggtagacacaagggatttaaaatccctcgcctttcgaggcgtgccagttcaagtctggcttcgggcaccatttaaacaccaattcaaagattttaaaatttattttaaaatcatctaattgggtcgttagctcagtcggtagagcagcggacttttaatccgttggtcgaaggttcgaatccttcacgacccaccacttaaaaataaagtaagcaccgaaaggtgtttttttattatctaaatctctgaaactcatataaaaaatccccgactcaaagaatcagggacttttacaatcaaacgtctttaattaattaacgctcattccaacgtttaatagactcacgaatcacttctttcgcttcttctacatcgccccaatgagttactttcgttgagccaggtttcttaagcgctttatagttattgaaatggaactcaatttgtttaattaagtttgccggtaaatctgctaatgaattgtaagcatttcctgtatcacgatcatctgcaggaacacaaacgattttatcatccacttcgccatcatcaacaaatttcatgacaccaattactttagcctcaaggaatacacctgttgctaatggttggcgagtgattaataacacatctaactcatcgccatcttcatctaaagtttgtggaatgaaaccatagttagttggttttgcaaaaattgctggctcaacacgatctaactggaatgccgcaactttacggttccattcgattttatggcagctaccttctggaatttcatttactacattgataatgccagcatctacatcgcctggcgttaaaatttgattaaaatcagccattttgtttccttcattttatcaagttaaaaaacgcaacaagtatagcagnttttctgcgaactcgcagtctcatttgtagagaaaatcagcaaatagatccatctcataactattcataattttgaccgcactttatcctaaataaaactcacgcaaacgtttacttatcgtttttatgatgtaaaatagcgcaccttattacttccaattttttacttaacttcaaggaacactatgccaactttagaaaaaacatttgagctcaaacaacgtggttcaactgttcgtcaagaaattatcgcgggtttaaccactttcttagcaatggtttattctgtcatcgtggtacccaatatgcttggtgctgcaggtttccctgcggaatctgtctttattgccacctgtttagttgcaggattaggctctatcttaatcggcttatgggcaaatgcaccaatggcaattggttgtgcaatttctcttactgcttttacagcatttagcttagtgattggtcaaaaggtcgccattcccgtngcgctaggcgcagtattcttaatgggggttgtgtttaccttaatttctaccacaggtatccgtgcatggatcttgcgtaatttaccatccaatatcgctcatggagcaggcattggtatcggactctttttacttttaattgccgcaaacggtgttggtttagtcgtcagcaaccaagctggcttaccagtaaaattaggcgatttcacctcattcccagtcatgatgtccttaattggcttagcgttaattattggccttgaaaaaatgaaaattaaaggcggcattttatgggtaattatcgctattactatcgtaggtttaatttttgatccaaatgtaaaatttggcggagagattttcaaaatgccaacctttggtgaaaattctcttttcttacaattagactttatgggcgcactacaacccgcaatcttgcctgtggtatttgctttggtgatgactgccgtatttgatgcaaccggtacaattcgtgcagttgcaggtcaagcagacttgcttgataaagatggtcaaattatcaatggcggtaaagccttaacttcagattcaatcagtagcttattctcaggcttattcggtacagcaccagctgccgtttatattgagtcagcagcagggacagcagcaggcggtaaaacaggtattactgctatcgttgttggtgtgttattcctattaatgcttttcttccaaccattagctttcttagtgccaggctacgcaactgctccagcattaatgtatgttggtttattaatgttaagcaatgtaagcaaattagatttcgatgatttcgttggcgcgatgagcggattaatctgcgcagtgtttatcgtacttaccgcgaacatcgtaacaggcattatgttaggttttgcggcattagtaattggaagaatcgtgagtggcgatattaaacgcttaaatgtaggtactgtgattattgcaatcgtacttgttgcattctatgcaggcggttgggcgatttagtaacagaaataagaaaagggaaaagccttcccctcaattttaatcacaaaagtgcggtgaaattttaccgcacttttttatacttggattactctttcttcaataagaaaataccgtggatcagataaatttacataagcttgttttaaaattggcattaaaatccctctggtttacaatttaccagtaaatctttgccccgcccagtttgcaaccacttccccaatggttgccccatataaaccgcacttttaatctcgcaacgttgtgcatcgctaccctctgcagcaagataaattgcttctgggcgaatacccactaaacattcgccatcgggtaaattaaactgtgcagcatcttttaaaggcacagagtaaccattaatatccgccacgccattttctaattttccatcgaaaatactggattcgcccataaagttagccaaaaacagagaatttggtcggagataaagctctttcgccggcgctttttgcataattttacctttattcatcacaatcacttcatcagataccgcaaatgcctctgtttgatcgtgtgtcacataaagcgaagtaatgcctaaacgttgttgcaattcacggattttttcacgcatagaacgacgtaagtttgcatctaaattacttaatggttcatcaaacaataggacttttggtttcaataccaaagcacgagccaatgcgacacgttgttgttgcccaccagaaatttgatccacgaaacgatcttcaaagcccgctaaatccactaattctaaagcctcttttacacgctgagcgcgttcttctttgccaatgccttgcatttttaagccgtagcccacgttatcgccaatgctcatatgcgggaaaagcgcgtaagattggaaaacaatacaaatatctcgattctgaatagaggattttgttacatcttcgccatcaataaatatttgacctgatgttggattttctaatcctgccactaaacgtaatacggtggttttaccacagcctgatggccctaacaatgttaccattgtgccacgtttgatcgttaaatctaaattatcaatgacgaccgctttaccaaatgcttttgtgatattttttaatactaagaaatcattattactcataatttttacctacaacttaacgagttaattcatttttttcgctttagaacgggaaatacgcgtatcgcctacaatccagtcgaaaaacaaaataattgccatcatcacaacaattaaaatagaaccgtatgcaatcgcaatgccgtattctccgtcttccacacgatttaaaatatatgcggtagacgcgagtntctgctgtcactaagaatataatcgcacttaccgtcgtcattgcacgaacgaaactagtcactaaagcagaaagcaacgcaggttttaataatggcaatacgataaagcacaatgttttccacgaactcccttttaaagaaagcgatgcttcatcaagggatttatcaagctgtcctaacccagcaatcgctgctcgcataccaatgggtaaatcacgcattaccattgaaataatcacgataatgcccgtacccgtaatataaagcggtgcattgttgaaggctaaaatgtaagacaccccagccacagtacctggcacggcaaaacaaagcatagttaagaactcaagggattttttaccttggaaatctttacgcaccacaatatacgcaatcaataatccaaagaatgcagttaatggcgcagcaatacccgcatagattaaggtattgattagtgacggccacgctccatcgctcaatccttgcccgaataacatggcatagtttttcaaggttaaagtgtaatttacgccccagtttacagtgaaacttccgtagaaaatactaccgtaaagtgccatattaaagattacccagaagccaagcataccgatgatggtatatttcaagccatttggcagctcttgcacatcgccacgataagatttccccgaaacagtgacataagagcggttaccaatccaaatgtattgaatgataaaaatcgccaacgagaaaattaacaacatcgaacccaaagtactggctgaagcataatcaagttgtgaacccgcaatatagaaataaatttgtgtggcaatcacatcgaaacttccacctaacactaaaggattactaaagtccgccaatgattgaatgaatacaattaagaaagaatttgctaatgctggacgcagtaacggaaaaataatctgatagaacgtttgataacgattagcacgcaacgtataagacgcttcttcaatagacgggtgtacggattttaatgcgccatctaaaatcataaaagaaataggagcaaatgcgagaatttgagcaatcgcaatcccattaaaaccataaagccaattatgactagaaaaaccaaaattcgtacttaaaaattcggttacataaccagaacgtccgagcattaaagtaaccccaagtcctacaacaaatgggggcgtcacaattggcaaaatagagaaaatttttccgataaatgccgttctacgagcgatacgcgtggtatagagcgcaaaggctaaaccaaatacagtagaaacgatgcccacaaagcccgataagaaaagcgaattggtaattacgcggacaatatagctctgcgttaaaattcgcatcacttgttgtggcgcaaaggtatcgccgtcataaaacattgaaacgaaaatcgccaatgttggataaacgataaagaagaaaatgagcaagataatgcaaagcaaagaagcgatgataaatttatcaccttgcatcacttttagttttgccaatgaaagtgtcgccaatgcggtatatcccacaagtaacacaatcacagaatagcccatactaattttgtacaccgtcgcactgataaacataaacagtacagaaagtgcggtcaaaaatagctctgtttttgcttgggtttgctgtggcaatctcaataacggcaaagcaccatacacaattacaggcaggaaccaagcccaagttaaattgaaagaagcccagcccattgcctctaaatattatctgaagtactttcaaacaaaccgtaatcaagtgcattggaaggcagaagtgcaaacgctaacaaggataaaataatccaaaaataagcagaatgcattatggaaagtttttttgcgttcatacaacctcgcagtaaagaaaacctgactttcgcctagggtaagtaggccctaggataattacagtaactcccctattggggagtaaaaagctgtcccaaaggggaactactattacgataattagccgtgggtatacttactcacggctatgattgtcacgaaaactatttcgccaatttaacttcttgaacccatttttcaattaaggctttgcgttgttctgttgcaccgtatttttcaaagtcataattgattaatttgagtttatttggatcaaatgcagttggcgattgttctgcggtcgtgttagttaagatttgtaaagaatccccttgtttccaagctaattcttgaccttcttttgataaagcccaatcgacgaataattttgcattatcaatattacgcgcaccttttaaganactcacgccacctaattcatagcccgttccttcgcacggcacaactaattctaatggcgcaccattgcgtttttctaaagcataatcgtgtaagaaacccaccccaattgtcnttcgccacgcgcagagttacgtgatggcgtgatacccgatttggtatattgagaaacattaggatgtaactcttttaggaaatcgaatgcctctttttcgccccataattgaacgaaagttgccaatgcagtgtaagcagtacccgcactttgagggtctgcaatttgaacttcaccttttaagcgtggatcggttaagtctttccagcattttggcacttctttaatacctaattttgccaaacgttcagtattcacaccgaaacctaagatccccatataaattgaggaaacataatggcctttcgttttcgctggttcacggaaacgttctacaatttcatcaatatgtttggatttataaggctcaattaaccctaattctgccgcttgagcttgagggtcaaaagtaccgccgaaccaaacatccgcttgagggttatttttttcagcttcaactttagcaaaagtactgcctgaaccattacgaataaaggatgttttcacatcatatttttcgccaaatgctttcgtggtggtttcgcacaaaatattggttgcactacaatatacaactaaacgacctttagcgttagcagaaccagaaacagccaagccagcagctaaaagtgcggtagaaacagaaagagaaattttgttgaatttcataatacatactccttattggataaaatgtttgaatcctacttgaaaaatagaaataataccgtgatgaagttcacagtttttaaaattcaagtgaaaaaatanacgtgaaattcaccgcacttttctttataattgcaagaattttccttacatcgaaacacgattatgtcaaatccctcttgtatcatcatcgccatcacaggtgcatctgcatcaggcaaaagttctatcgcttccactgttcacaaagagctctgtaatgaactaggctgccaagaaattggtatcattactgaagacagttactataaagatcaaagtcatttagaaatgactgagcgggtaaaaacgaattacgatcatccaaactctatggatcgcgatttacttatccaacatttaaaaaatctaaaaaatggcagtgcagtagatgtgcctgtttatagctatgtagaacatactcgcaccaacgaaacaacgcatttcacaccaaaacgaatcgtaattttagaagggattttattacttaccgatgaacgagtacgccaattagccgatatttctgtattcgtagacacaccacttgatatttgtttcatccgccgtttacaacgtgatatggaagaacgtggtcgctctctacaatcagtgattgatcaatatcgtgcaaccgtgcgtccaatgttcttacaatttattgagccgtctaaacaatatgcggatattgtcattcctcgtggtggtaaaaatcgcattgcgatcaatatgttaaaagctcaaatccttcatttattgaatcaaaaataggaaatcttatgcgtctttgcgatactgatattgaacgctatcttgatgatggcattatttctttaacaccacgtccaaataatgacaaaatcaacggtgcgacaattgatgttcgcttggggaattctttccgtgtatttcgtgaacactctgcaccttttattgatctaagcggcccgaaagaagaagtatccgcccagcttgaatcagtaatgagcgatgaaattattattccagagggggaagcatttttcttacatcctggtactttagccttagcaaccacgcttgaatccgtgaaattgccagccaatattatcggttggttagatggccgttcttctttagcccgtttaggcttaatggtacacgtcaccgcacaccgtattgatccaggttgggaaggaaaaatcgtgctggaattttataattcagggaaattaccattagcattacgcccaaatatggtaattggtgcgttaagttttgaagtattaagtggcgaassaaaacgaccatacagtagccgcaaagatgcaaaatataaaantcaacaaagtgcagtagccagtcgtattgacgaagacaaggaataatcgatgaaaaagttcgcacttatcgtagggatcgtcgctttggcgatcttttcttttttatatattcaactttaccgcgtgcaaagtgctattaatgmacaactggcacaacaaaacattgccgttcagtcaatcaatttatcattattttctcccgcactttcccttgaaaatataaaaactacgcaattttcagctcaaaaaattgaagctaaatttagttttttgcctcttttgtatggaaacgcagcacttcattcactgaatattcaacagctcaaattaactcaaaacacacaaaatcctgccaatgtatcgatagagatttcgcctttttcattaaaacagcttttatcaaaaaaagtaatattaaatggcgaaaaccatattcgcattgaatttaataaacctatttatggaaaaacaaaaactttccatttttctttccataaagcgaatttagacttctcaacatcagaatcaaccccacttcaatttgtagatgcaagcctaaataatcagcctatcggttatattgaaactcacacagcccaccaacaaatagtgacttatataaaaccacaatgcgataacgattgtttagccgtattgaaatatcaacaaatagacaatcaaagtgcggtaaatttttcgggtaaatatttccctgttcaacgcttattcgcactattaaatttgccagaaatgttaagtggacacgccgattttgatcttgatttcagcttttcatcttcctcgcttattcaaggaaaattaaattttttagcgcaaaatggcgaaattcttggtgtgaatttattggatatggtagcgcaatatttcccgattaattacaacaatgatttgttacaaaacaaagaattaaacactcgctttgaacaattttacttacaattatttctccaacaaaatcaactcattgctgaaaaaatcgaattaaaaacgcccgcacttttggggcaaggaaaaggcatcattgatttaaatcgaatggaatgcaatgtggatattaatttaaattctacggatcaacgctatcaaaatttgacacttccaatcaatttttttggtaactgcaattctccacaatacaaaattaattttacgaagaaattccgccatcaattaattgatgcgattaaagaaaagttacgttaatgtcgttatatttaaaagctgaaaaaatccaatcatggcgcgtgcttattatggcttgcgcaggatttatttttaatactacagaatttgtacccgttgcaatgttaagcgatattgcacaaagttttgatatgcaaaccgccgatactggtttaatgatgacagtttatgcttggacggtgctaattatgtctttgcctgcgatgcttgccacgggcaatatggaacgtaaaagtctgcttattaagcttttcattatatttattgttgggcatattttatcggtcattgcatggaatttctggatattacttctcgctcgaatgtgtattgcattagcacattcggtgttttggtcaattactgcctcacttgtgatgcgcatctcacctaaacacaagaaaactcaagcattaggaatgctcgctattggcaccgcacttgccacaatcttaggcttaccgattggacgaattgtcggacagctcgtcggttggcgggtcacttttggcattattgcggtactggcattatccatcatgtttttaattattcgattattgccaaatttacccagtaaaaatgctggctctattgcaagtttacccttgcttgctaaacgtccattattactttggctttacgtaacaacggcaatcgtcatttcagcacactttactgcttatacttatatcgaaccatttatgattgatgtagggcatttagatccaaattttgccacggctgtattattagtttttggtttctcaggcattgcagcaagcctattatttaacagattataccgatttgctcccacaaaatttattgttgtttcgatgagtttattgatgttctccctcttgctactcctcttttcgaccaaaacaataatagcaatgttcagccttgtgtttatttgggggattggcatttcttgtatcggactatctctacaaatgcgcgtactaaaacttgcgccagatgcaaccgatgttgccacagctatttactcgggcattttcaatgcaggaattggcgcaggcgcattatttggaaaccttgcgacaacctatttaggattaaatgaaattggttatacaggcgcagcattaggtttaatcggtttcatcatttttattacaacgcacttaaaatatcgccatacatttcttctgcaaaacaaataaaaaaataaccgcactttagttctccaaaaagagttttaaaagtgcggttaaatcttgctaagttttatttatcttgcgtttaacgtttcgctttcttaataaatttcatcaaacgtttacgtttacgcaattggttcggagtgagtttatttttgcgtcctgcaaatgggtttgagccttcttggaaaagcagacgaatcggtgaaccaataatttttaagctcttacgataataattagataaataacgtttataagaatctggtagtttatccatttggttaccgtgaaccactataatcggcggattataaccacctgggtgagcatattttaatttaatgcgacgaccgccaatcatcggcggttggtgctcatccgttgccatttgcaaaatacgagttaaaagcgaagtcgtcattttttgagtggcacaagcataggcttctttaatcgaatcaaaaagattacctacaccacttccgtgcaaggctgaaataaaatgcacccgagcaaaatcaataaaatctaaacgacgatcaagttcagatttcacacgatctttcacatcttgatctaaaccatcccatttattcacgacgatcaccaaagaacgccctgcatttaaaataaagccgagcaaagataaatcctgatcagaaatgttctctctcgcatcaatagtcagcaatacaacattagcatcttgaatcgcttgtaaggttttaatcacagagaatttttccactgccaaatgcactttaccacgcttacgcacaccagccgtatcaatcaaggtatattgctgcccatcacgctccattggaatataaatactgtcacgtgtcgtacctggcatatcaaaaaccacgacacgatcttcgcctaaaatacgattggttaaagtagatttacccacatttggacgaccaacaatggcaatcttaatatttttatcttgttcttcttcaagttcttcgtctaacgcatcatcaattaatgccgtatcttcttctgaattcaaaatcgaattcttgttcccattcgtcttgttcttcctcagaagtgcggtcattttcatcggcgttttccattttttccgcaaaaggssgcaagtacttgttccattaattgagtaacaccacggccttgtgaggctgcgatttgctcaatttcccctaaacctaactgataaaattcagcacaatgggaatccgcatcaataccancagttttatttgccaccaccacagtaattttgttttgacgttggcgtaaataattagcaataccaatatcagctgccgttaaacccgctctagcatccacaaggaaaagaacaatatccgcttcatcaatagcaagcaaagattgctccgccattttttcttctacaccctcttccgttccatcaataccgccagtatcaataacaataaaatcatagccagcaatatgtgcgtgaccatattttctatcacgagttaaaccgggaaaatcagcgactaacgcatctctcgtacgagtaaggcgattaaataatgtggattttcccacatttgggcgaccaacaagggcgacgactggagttgccataaaaaatctcttattttgtcaaaaatggcgactattatatcggaagttaaaggattggtaaaaaatcatttcataaagaaaagaaaaagccacaggatacaatcctatggctttctaaatactgtttatttatctacaacttaacgttataataatctcgctttcaaggattcagcttgaaagcgagtgttgcgctttttcgcaacgtttgaagaggataagaaaatgattaagatcattatccttgtcgtactactattattagtgagccagcccgcttactaataacacgacatactagggagtaaccgctccctagttcttcaaatattaaaagtttactttatttttgtcaagatgaataaatttcagatacaaaaaaagcacccttaggtgctatctttatttatctttatttatcttaattggcggaatggacgggactcgaacccgcgaccccctgcgtgacaggcaggtattctaaccagctgaactaccactccgagataagatattaattttaaattggcggaatggacgggactcgaacccgcgaccccctgcgtgacaggcaggtattctaaccagctgaactaccactccgctaagtggtgcgtatcttaatgatgaacacaaatctcgtcaatctttttttattaaattttacttacctgcttaaattccacacgattaatgcacattattattgccaaaacgtttatcccaaaggcaattatttccactttttttattcatcatctttaagaattctaaatgcgcttgtagctcatcattagtaggttgaagtaatttcaaattgtgcgaaaaatctaccgcactttttatttcttccgccgttttttcttgcataacacggataactccagactcaacagattcttcttcatcgaataaatttgtttgccctcccgtcatcatcaaataaacatccgccaagatctcggcatccagtaacgcaccgtgcaaagtacgtttgctattatcaatacctaaacgatcacaaagtgcatccaaattattgcgttttccaggatacatctgacgcgccatttgtagcgtatctgtcaccaaacaaatatcgtcagttttcacattgaggttaagtttacgaaattcataatccataaatccaacgtcaaagggggcattgtgaataagcaattctgcgccattaatataatccaaaaaatcttgggcaacttctttgaattcaggtttatccgctaacatttcatcagtaattccatgaactttaatcgcatcaggatcancggggcgatctggcttaatataaatatganaattattacctgtgtaacgacgatttattaattcaactgcaccaatttcaataatgcagtgtccttcataatgcgcgccaagctgattcatacctgtagtttcagtatctaatacaatttggcgattgggattaatcatttgttcaacctatctctttccattaaaatacttgccattctacacaacaacctttttgttatgccnaaacagattgaaatttttactgatggatcttgcttaggtaatccaggggcgggcggaattggtgccgtattgcgttataaacaacatgaaaaaacactctccaaaggctatttccaaaccaccaataatcgaatggaattacgcgctgtcattgaagcattaaatacattaaaagaaccttgcttgatcacgctttatagtgatagccaatatatgaaaaatggcataaccaaatggatctttaactggaaaaaaaataattggaaagcaagttctggaaagcctgtaaaaaaccaagatttatggatagccttagatgaatccatccaacgtcataaaattaattggcaatgggtaaaaggccatgctggacacagagaaaatgaaatttgcgatgaattagcaaaaaaaggggcagaaaatccgacattggaagatatggggtacatagnagaataatacaactgatataacgtcatatttttcgatacctaaaaatatttaatacttaaacctaaaacagaataaaaaataatcaaattcatttaaaaaatgtgatctcgatcagatttcaagnaaattaaaattttggagtattgacatcaaaaattttttttgtaaagatgcagctcgtccgttttggcgattggacaattctattggagaaaagttcaatcatagatagtaaacaaccataaggnatacaaattatgaaaaaaacacttgcagcattaatcgttggtgcattcgcagcttcagcagcaaacgcagctgttgtttataacaacgaagggactaacgtagaattaggtggtcgtttaagcattatcgcagaacaaagtaatagcactgtagataatcaaaaacagcaacacggtgcattacgcaatcaaggttcacgtttccacattaaagcaactcataacttcggtgatggtttctatgcacaaggttatttagaaactcgttttgttacaaaagcctctgaaaacggttcagataacttcggtgatattacaagcaaatatgcttatgttactttaggaaataaagcattcggtgaagtaaaacttggtcgtgcgaaaactattgctgatggcataacaagcgcagaagataaagaatatggcgttctcaacaatagtgactatattcctactagtggtaataccgttggctatacttttaaaggtattgatggtttagtattaggcgctaattatttattagcacaaaagcgtgagggtgcaaaaaatacaaataagcagcctaatgataaggctggtgaagtacgtataggtgaaatcaataatggaattcaagttggtgcaaaatatgatgcaaacgacatcgttgcaaaaattgcttatggtagaactaactacaaatataacgaagctgacgagcatacacagcaattaaatggtgtattagcaactttaggctatcgttttagtgatttaggcttattagtgtctctagatagtggctatgcaaaaactaaaaactataaaactaaacacgaaaaacgctatttcgtatctccaggtttccaatatgaattaatggaagatactaatgtctatggcaacttcaaatatgancgcacttctgtagatcaaggtgaaaaaacacgtgaacaagcagtattattcggtgtagatcataaacttcacaaacaactattaacctatattgaaggtgcttacgctaganctaaaacaactaatggaggcgtaaaaactgaaaaagaaaaatcagtgggtgtaggtttacgcgtttacttctaatcatttgttagaaatacattattaaaagcaaggcgaatcgaaagattcgcttttttttttgctcaaaatcaagttaaaaaatgattaagttaaaagtgtataaatatttaggctattttataattaataaaaaatctgtgatatatatcacagatttttaaatcaattaactatttaagtgtttactattaattctctttccactttccgtttactactgtgccgattacttggtaatttggcgtaaacacggctaagtttgctatcttacctttttctaccgaacctaaacgatcatctataccaattgctcgtgcaggataaaggttactcattctaatggcttccgcaagaggaatttcgacatattctaccgcatttttaatggattccatcattgtgattgatgcccctgcaattgtgtcattcgcatcatagcaacgcccttctttgatataaattgtttttcccacaaaggtaaaactttctagttctggcggtgcgcctgcagctgcaatagagtcagtcacaatacaaagtttgtcgcctttgatttttttatcaatgcgaacattgccgtaattgatatgcacaccatcgacgataatgccagtgtaaacatcagaatctaatactgcacccactacgcccatttcacgtccagaactaattggcgacatcgcattatgcaagtgagtcgcaaaagttgcgcctttgtggaatgcggctttagccacttcataagtggcattagaatggcctacagagacaataatgcccgctttcacaaaatcaggcgtatagttaatggttgggttttctgcggcaatggtcatttttgtaatcacatcaccattttcgcagagaaaatctttcatttcaggcgtaatttcacgaatatattcgggacggtgtacgccttttttctcaatgctgagataaggtccttcaatatgtaaaccaagtgcttggtttttatgcttgtttaaatattcacgcataatttttaccgcactttttatattttcatcaggcgcggtaataaaagtgggaaggaaacttgtacaacctgattttaagttagtttcctgcataatttccaaggtttcaacgctagtttggtcgttaaacatcacgccaccacagccatttaattgcagatcaataaaaccagccgttaaattattaccttgtaaatcaatggttttgatacctgtttctaattcagcttgggggatcactgcttcaataatttcaccgttaataattacagcaaaatcacgtaaaacatcatattttgtgtaaattacacaattaattaatgcgtatttcatattctgttcctaatatcaacatcagtttaacatagcaactatattgctcttaaacgtaaggacaatttgccctatgattgtttgtgattatagggcgaatgtaattcgcccctacataaagatgaagaatagatctctatttatcctgataatccgtaccagcaaccgcgccttctaattcagtaaaatatttcacggttttcacttttagctcttgttgagattatagggcgaatgtaattcgcccctacataaagatgaagaatagatctctatttatcctgataatccgtaccagcaactgcgccttctaattcagtaaaatatttcacggttttcacttttaactcttgttgagcagcttcatcacaaacaagcaagaaatgacggtgcatttgtaatgcactgactgtccataaatggttaatactgccttcaactgcagcttgcactgccagtgctttttgatgtcctgttgctaaaatcatcacttcttctgcatctaataatgtgccaacaccaatggttaaagcatatttcggcacttgagtaacatcattattaaagaagcgtgaatttgcaatcaatgtatcttgcgttagcgttttaatacgggtgcgagaacttaatgaagaagcaggttcattaaatgcgatatgtccatctacgccaaccccccccataaacagatgaattttgccgtaggatttaattttttcttcataacgacggcattctgcattatggtcatcggtattgccgttaagaatattgatattttcaggtaaaatatcgatatgattgaaaaaattgttatacataaagctgtggtaactttcagggtgttcctctggtaaagccacatattcatccatattgaaagtcactacgtgtttgaaactcactttgcctgcttgataaagtcgaatcagttcttgataagtttttagtggtgtgccaccagtaggtaaccccaatacaaaaggacgctcggcggtaggtttaaaatcgttgatacgattgatgatatgttgtgcagcccaacaactgacttgttgttctgtttgtaatggaataaaacgcatattagccttcctttattattgaccgtgatgatcctattcatatcgtaggctggactttagcccaccctacaccaaaggatcattataagtgcggcaattttctatcttgtttttaaaaagaaattcttttgctccaataatttacgacagagcaatagaagttgcccccttccgcccttcgggcaccttcccccgtaaacaggggaaggaaagtgcttgctgacttgctgttctgtttgtaacggaataaaacagggggaggtaagttttttctaatttaaatatttatgacaaaaatttcgctttcaagtcttttgcttttgcaagctgttcttctgttgcttttgatgtcattggttcacggcaataacctgcatccaccccttctaatttaagcaattctttgatggttaaatataaaccgttcgctaaaatgccttcgattaaatcgttggttacgtgttggatttctaacgcttcggctaatttacccgctttggttaattcaaaaatttgacgagcacgaacgccgtttacgttaaaggttgaaccaattgcaccatctaccccaagtgatgctgcaggtaacatcatttcatcgaaacctgcccaaattaagtggtttggataagcttttttcaaacgttctaataaatagaaatcacctgctgtgaattttacccctaatactttcgggtttttataaagttcaccgaattgttcaatgcccatattcacgccagttaagaacgggatagagtacacaatcatattgttgcctgtttcagcgatgatggtgtcgtaataatgtttaatttcagggaagctaaatttgtaatagaatggcgtcactgcagataagcagtcgtagcctaattctgttgcatatttacctaattccaccgcttcttttaagtttacactacccacttgagcaattagtgcgatttgatcttttgcttcatcttttgcaatgcggaagatttcttttttctcttccgttgaaagcataaagttttcgcctgttgaaccgcccacatataagccatcaactttcattttgtcgatattatggcggataatttggcgtaaacctttttcattaatggtgccatcttcattaaatgacactaataatgcactgaaaataccttttaaatcacgcataagttttctcctattttatacgttgttcaagaattacattgagagttttttgtttagtttgagcggcaatatcttcttcgccctgcactaacaaagcataaattaaatctaatacaaaaagctgtgcaattttggtgccaatagaatcgccttgtaacttgccttgtttattaccatttaccaaaacataatcagcatattctgtcacgggggaacgcaaactatgcgtcaatgccactgttgttgcaccattttgttttgcgattttgatggtatgcgccgtttcagcagaataaccagaatggcttaaaccaattgccacatcagaagaggtcaataatgccgcctgcatatacataaaatgattattacctgaagcatccacttgaaaaccaatacgcatcagcttatttttagcatcttcagccgttacgccagatgaacccaccccaaataaaaaaatacggcgtgcttttttaagtactttaacgacttcttcaagctgttttaaatcaagtaaattaatcgtttcttccattacattagcaaccgccgtttgcaatttttgtgcaatagtgagcgaatcatcacttggcataatttctgtttcaagtatgctttcatcttgattatctttcgtcgcaagttcaatagaaagctctagtttgaactcgctgaaacctttaaaaccaatggttcgacaaaaacggacgagcgtagcttctccaacttgcaaatgtttagcgatttctgaaagggagcattgagagactaaatcaggcgaacgcaaaatcgtatcggcaatttttttctctgatttagttaaactctggtaaagtgagccaattttgtttaacacatttcccgatttagccataaattgttccttcaggcttatccagtaaaacatcttttacccaataagctgcgccaattaaacctgcatcttgtccaaatttagcggtttcaatttcacaacaatatatcgaaggaaaatcttgtaaatatttttcaaccaaagataaatatccctcagctaatcccacactgccaccaatcgcgattttttgaatatctaaactaatcactaaatcagcaattaaattagcaatggctttcgcagaacgctcgacaagtgcggtcgctttttcatcattttttctaaaacgctcaaacacttcttttggatcgcacggttcttcccattgggaagaaactgcttcaattgctcgccctgaagcaatcgcttcgacacaacctcgacgcccacaaccacagatcgcaccatttggatcagctaatgtatgaccaatatgcccagcaataccacgagaacctgtctgcaaaatttggttcagcacaatccctccgccaactcctgttgaaacggtaataaaaacaaaatttgatacctgttcagaattttgcaattgatattccgcataagtcgcagcttgtgcatcatttaataaaccaatcggtttatccgtatgttttgcaatactcgctttaagtggaaattccgccaagccacctaagtttttcggatttaatgcacttaaaatgccattattgatgatccccgtagatgctaccgctacataatcaaactgcccttcataatcagcaagcaatttgcctaacgcttggtgcattccctccacgacattttcacgtggtgtatgaatttgctgacgttgctcaatttcgccattttttacaatcgccgctgcaatttttgtcccaccaatatctagtgctaaacaacgcataacttatccttatagtgtaaagtckttntctcacacgtcttacgactatcttgcagatttcactgaattagcaaaccaactcacaatatgttcaagacgagttaaggctgaacctacagtcacgcaatctgcaccaatttcaattgccacttttgccaattctggtgtgttataacgcccctcagccatcacaaaacaacccgctgattttaaatctttcactaattgataatctggttcttctggcactgcgccacctgtataacctgacatcgtactgccgacaatatcaaaaccaagcgctttacaatacaagccttcttctaaattaggaacaatctgccattgccaaacagcccatttcgtggatttttttcaccgcactttcaatatccacaggacgtggacggctcgtgccatctactgcaataatatccgcgccagcattggctagatcttcaatatcttgtaaaaacggcgtaatacgcacgggactatcaggcaaatcacgttttacaattccgataatcgggacattcacaaaaggacgggttgctttaaggttatcaacaccctcaatacgtaagccagaacgtccgcccataactgaagcctgagccatagcagaaacgatttcaggtttatccattgggccatcatcgacaggttggcaagaagaaataagaccatattgaatttgagaaagcacttcttgataagataatttagacatataacacccctcatttaaatctgaataaatcactttaaaattaatttaatccacacaaaacaatcttttataagttgtaatatgcttatattttcatcatttaaccttattatatgaaaaataaatgccattttaaagaatatttttgaagtgttttttcataaatgtgatcaacttctcattttggaaataaaactcgtaaaactattttaaatttgtttttttactcttagaattgctctcgaatcctattttgggggagaaaacatacatttttggcctaaattgattctcatattacggggttaatctatgcccctttccaacataagttcacacaggagcgaatatgatgaaattgacaaaacttttccttgccaccgccatttctttaggcgtatcttctgctgttcttgccgctgattatgacttgaaattcggtatgaatgctggaacttcatcaaatgaatataaagcggcagaaatgtttgccaaagaagtcaaagaaaaatcacagggtaaaattgaaatttcactttatccaagttcacaattaggtgatgaccgtgcaatgttaaaacaattaaaagacggttctctcgactttacctttgcagaatctgctcgcttccagctgttttaccctgaagcggcagtatttgccttaccttatgttattagcaactacaatgttgcacaaaaagccttattcgatacagaattcggtaaagatttaattaaaaaaatggataaagatcttggcgtgactttactttcccaagcttataacggaactcgccaaacgacttcaaatcgtgcaatcaacagtattgcagatatgaaaggcttaaaacttcgtgtgccaaatgcagcaacaaacttagcctatgctaaatatgttggtgcatcaccaacaccaatggcattttctgaagtttatcttgcgttacaaaccaatgccgtcgatggtcaagaaaacccgttagcagcggtgcaagcacaaaaattctatgaagtgcaaaagttcttagcaatgactaatcatattttgaatgaccaactttatttagtaagcaacgagacttataaagaactccctgaagatcttcaaaaagtcgtaaaagatgctgccgaaaatgcagcaaaatatcacactaaattattcgtagatggagagaaagatttagtcacattctttgaaaaacaaggcgtgaaaattacacatcctgatcttgttccatttaaagaatcaatgaagccgtattatgctgagtttgtaaaacaaactggtcaaaaaggtgaatcagctttaaaacaaattgaagcaatcaatccataatccctctttagtgtgccgtaatggccctacattcccttattcttcatcaaacggagtgagtatgaaatatattaataagcttgaggaatggctgggtggcgcattatttatcgccattttcggtattcttatcgctcaaattctttcacgccaagtttttcattctccgttaatttggagtgaagaactcgccaagctcttatttgtttacgtgggtatgttgggtatcagcgttgctgtgagaaaacaagaacacgtatttattgattttttaactaatctaatgcccgaaaaaatcagaaaattcacaaatacgtttgtacaattattagtctttatatgtattttcttatttattcatttcggtattcgtacttttaacggtgcatcattccctattgatgccttaggaggcatttctgaaaaatggattttcgcagcactgcctgttgtcgcaatattaatgatgtttcgctttatccaagcgcaaaccctaaactttaagactgggaaaagctatttacctgcaactttctttatcataagtgcggtcattttatttgcgattttatttttcgcgccagattggttcaaagtattgcgtattagcaattatataaaactcggttcaagttcagtctatgtcgccttactcgtttggctaatcattatgtttatcggtgtccctgtaggttggtccttatttattgctactctactttatttttctatgacacgttggaacgtcgtaaatgccgcaactgaaaaattagtctatagcctagacagcttcccattacttgccgtgccattttatattttaacgggcattctaatgaatacaggtgggattaccgaacgtatttttaattttgctaaagccttactcggtcattacacaggaggaatgggacacgttaatatcggcgcaagtttattgttctctggtatgtcaggttcagcacttgctgatgcggggggcttaggtcaattggaaatcaaagcaatgcgtgatgctggttatgacgatgatatttgcggaggaattactgctgcttcttgtattattgggccattagttccgccaagtattgcaatgattatttacggtgtaattgccaatgaatctatcgcaaaactctttattgcaggttttattccaggtgtattaattactttagctttaatggcaatgaattatcgcattgcaaaaaaacgaggttatccacgtacaccaaaagctacgagagaacaactttgcagcagctttaaacaatctttttgggcaatcttaacgccgttattaattatcggtggtattttttcaggcttattcagtccaacagaatctgccattgttgcagcagcatactctgtaattattggtaaattcgtgtataaagaattaaccttaaaaagcttatttaatagttgcatagaagcaatggcaattacgggcgtagtcgccttaatgattatgaccgtgactttctttggcgatatgattgcgcgtgaacaagtcgcaatgcgtgttgctgatgtgtttgttgccgttgccgattcgcctttaaccgtattgataatgattaacgcactgttactttttcttggaatgttcattgatgccctagcattacaatttttagtattaccaatgcttattcctatcgcaatgcagttcaatattgacttaatcttctttggtgtaatgaccacattaaatatgatggttggtattcttaccccaccaatgggaatggctctctttgttgttgctcgtgtaggaaatatgtcagtttccacggtaaccaaaggcgtattaccgttcttgattcccgttttcgtcacattagtattaatcacgattttcccacaaatcatcacatttgtgccaaatctattgataccataataaaaagtgcggttgaaaaacattaaattttttaaccgcactttcatcgttttcgtaagttacatctgccgtatcttacaatacaaaagggtgcaataactgcactttatcaacgcctattcaatgccgtttaatgaatagaaaactgtaaacacaactcaaaatggggtttattatgaaactaactaaaacagcattatgtactgcactttttgccacctttactttttcagcgaacgcacaaacttatcctgatttgccagtggggatcaaaggaggaacaggcgcattaattggcgacacagtttatgtgggattaggttctggtggcgataaattctataccttagacctaaaagatccttcagcacaatggaaagaaattgctacatttccgggtggcgaacgcaatcaacctgttgcagccgcagtggatggaaaactttatgtattcggtggtttacaaaaaaatgaaaaaggcgaacttcaactcgttaatgacgcttatcgctataacccaagcgataatacttggatgaaacttcctactcgttctccccgtggtttagtaggatcaagtggtgcatctcacggagataaagtttatattttaggcggctctaatctctctatatttaatggcttcttccaagacactgtggcagcaggtgaagataaagcgaaaaaagatgaaatcgcagcagcttatttcgatcaacgtccagaagattatttctttacaacagaattattgagctatgaaccatcaaccaataaatggcgcaatgaaggtcgtattccattctctggtcgtgctggtgcagcctttacaattcaaggtaatgagctagtggttgtcaatggcgaaattaaacctggacttcgcaccgctgaaacccatcaaggtaaattcactgctaaaggtgtgcaatggaaaaacttacctgacttacctgctccaaaaggcaaatcacaagatggtttagctggtgcgctttcaggctatagtaacggtcattatttagtcactggcggcgcaaattttccaggttcaatcaaacaattcaaagaaggaaaacttcacgcacataaaggtttaagcaaagcttggcataacgaagtttatacgttgaataatggtaaatggcgcattgttggggaattaccaatgaatattggttatggtttttctgtatcttacaacaataaagttttactgattggcggtgaaactgatggaggtaaggctttaactagcgtcaaagcaataagctatgacggtaaaaaattaaccatcgaataatttatcacagaatagtgcataaaatttataataatcaaaagcggcgaaatttatcgccgctttatgcaaaataaaagtaattaaagcaaaattaagacaaattttgaccgcactttaaatgcgctataaagagctggcatttttattaataagatttagcgatgttatttattccaccaccactactctgtttattcattgccatagcaatgtattttttgccaaagattgctagttattctgtccatttttcagtgattgtttttgttatttccctttcatttttgattgctttaagcagcgttatgcaatctttatatgtaaaacctccattaatcctcgtgactttaaaggcacaacaaaattagtttccacaggcatatttcgatttagccgtaacccaatgtatttaagtttgctgttaattttgcttgcttggacgctttggttaggtaatagtttggcttggttaggcgtaattatctttatattagtgataaaccagtttcaaatagcccgagaagaaacctatttggaaagtaaatttggcgatgaatatcgtcgttacaaacaaaaagtaagacgttggctataaaaaaacaccttcacaaggaaggtgtttttatcaaattaaactctattttttcggtgcctgcataaagcggaagaaatcactatctggttttaaaatcattatattgtcagaatttgcaaaactcgcttcataggcttttaagctacgcacaaaagtaaagaattgtggttcttgagcaaaagcatctgaatataattttgctgcagctgcatcgcctgaacctcgtaattcttgtgcagttttatttgcattagcaagaattaacgtcactttgcgatctacatcagcttgaataaatgctgctttttctttcccttgagaacgatgttcacgcgccactgcatcacgttctgcacgcatacgttggtaaattgaagaagagacttcatctggtaaattaatttgttttacacgcacatcgatcacttcaatacctaattctgccgtactgtcttgtcctgaacttaaagctttttttgccccttccattaattctccacgtgtaccagaaacaatatctttaatcgtgcgtgaaccaatttcagaacgtaaacggtcgtttactttacgacttaataaatttgcagcttgagcataatcgccaccgccagtagatgtgtagaatcgaccaaaatcactgattttccatttcacataagaatccactagcaaatcttttttctcaacagtaacaaaacgtgttgcagagccatctaaagtacgaatacgtgcatctaaaactttgatgctatcaattaaaggcactttaaaatgcaagcccggttcatatacaaccactttgttatcagcatcacgctgtactttgttaaatcgtaacataatgccacgcgtaccttccgttacaacgacgatactagaataaacgactgccgcaatcacgaaaataacaggtaataaaaatctacgcattagttaaatctcccttgacgaatcggcgcaacggtagtcggctgaggctgataagaattttgacgttctggtgcagtaaaagcaggcgaagaattgaccgcacttggcgcacttgttaccgattttttgcccataatttgctctagcggtaacacagttaaattattaccattattgccatcaagcattacttttggggtatttgccatcactttttccatcgtctgaatatataaacgctcacgcagtaaatctggcgcagccttaaattctggcaacaagcgttgcaaacgttccacttcaccttttgcatctaacacgatacgatctttataagctgttgcttcttcaagaatacgttgcgcatcaccacgtgcaatcggttctttctcacgcgcataggcttccgcttcacgaataaaacgttgttcatcttcctgcgctttaattgcatcatcaaacgcatcttttacttcttcaggtgggcgcgcagattggaagttcacatcaataacctcaagtcccatatcataggatttgataatttcattcaaagctttccaagtattttcacgcacgacagagcgacctgtggttaaaatatcattcatagacatatgcccaataacataacgtaatgcactatctgtcgcttgattcaaactatcatctgcatttgttacgctaaaaagatattttgcaggatcttgcacacgatattgcacggtcatttccacttttaccatattttcatcttgagtcagcattgcaccttgtgtacgcaactcttttacttgctccacatttactggcaatactttatctacaaatgttggtttccagttcaaaccaggttgaacaatagaatgtaactcgccaaaacgaagcaccacaccgcgttcagcctctttaatggtgtaaaaaccgtttacgccccaaataatcgcaccaatcgctacagcaagtggaataactttaccaaaatgaaatggcgtattgccttgagaactgccattattttgaccgctctttttatttccaccacctaattttttaagcagattattaaaaatctcctcaatatctggtggagattgctcttgatttccacgattttgattgttattccatccattattattggatgaatttcccggctgttggtcgttgctttgccctggtttactccaaggatcgcgatctgaaccgttctgtgacatttcattctccatttgtcaaaaaattgttaagagtttagctaaataaatggggcacgtctatgaaaatacaaggctttttaggcaataaaaaatccttgattttatataaggatttttttgattaattcacttcataaagaacatatttttcaagttcttttatctgtaaactttctctattccattcataaaagtgcggtaatttttcttgatgattgacaaaagcggctaaataaatagggagttcatcagtaaaccacaactgcccctgcggacaataatctgaaaaaattttttgttgttcaggaaaatgacgaacattggataattttacgatcccaaatccttgagatttcaatacagcctctcgcaaacaccaacaacgataaaaagcgttcaaagaatcctgctgatgatgaaaccaatcaatttcttcttttggtgcaatatgttccatcaacgccgtaaaatttcttattttaggaaattcaatatcaattcccaccgcacttttttcttcatttctaatatctaatattaccgccacccaatcaccagaatggctaatattaaaatctattcgctcatcaagaaaataaggtctgccactttcagtacgatgaatttgagataaaagtgcggtggattttcctgctatttttagaagttggaaaagtaataaatgcgcaagccgacgacactgatgacgctgaaaaacacgggagctatccgtttcaatttgatatagattttctggaatcagttcatcgggtaaggattccaaagaaaaaggttgatttatattgccgtaggcgatgtaggttgtcataaaataaaagcaccattcaaaggtgcttttatattaaaaggatttagtttgtgtgtaaattagcgaatcactaattccgccacagaaacaccgaccaagcaagcaacaacaaccccaattaaacctggcaccataaaactgtggttaaaataatatttaccaatttttgttgtacccgttacgtcaaagtttactgttgcaatatctgacggataatttggaatgaagaratacgcataagttgcaggcattaaaccaactaagattggcgcaggaatacctaaaccaataccaacaggtaataacattacggctgttgctgcttggctattaattacaactgagactgcaaataacgccaatgcgaatgtccaagggtaagtttgcaccatatcagtaatcgcggctttaaattctggcattgcatatttgaagtaagtgtcgctcatccacgcaataccataaattgcaatcgctgctaccatacctgacttaaataccacaccattttgcacgatttgaggattcgttttcgttgcaagtaaaatcacaccaccaaaacaaagcatcatcatttgaatgataagtgacattgaaattgcttttccgctaccgatagtgcgaatttcaggaatcatcgcaatcgcaacaatcacaactaaagcaagtaaaaataggtaaacagatttttttgccccttgcggaagggtttcattcaatgttgtactggtagtatttaaaatacgttcgcgccatactggatcttgtaaacgacgttgatattcaggatcttgttctaactctttaccacgacgcatactgtataaagaaagtgcaatcgtacccgctaaggttgcaggaacggttacgcaaataatatctaataaactaatatgctcaaaagcgggcattgctgtaattttacctagataaaatacaacagctgcagaaagtgggcttgatgtgatggctaattgcgatgctaccgaagacgctgccattggacgttctggacgaattttgtttttcaatgcaacatcgccgatgattggcataattgtgtaaacagagtgacctgtaccaagcataaaggttaataaatagacgactaatgggccgagtaaagtgacacgttttggatttttacggagaatgcgttcagcaatttgtaacataaatttcaaaccgccagctgcttcaagtacggatgcgcaagtcaccactgcaagaatgataagcataacatcaatcggtgcttccccactggcatacgaaatacgaaaacctcgatagcaagaccgataccagaaacaacacctaatccgataccgccgtaacggctaccgatatagagcattaatagtaaaaataaaaattctaaataaagcataaacacctcaaaaatggaaaactatgcaaataatacttctttttaggcatataactaaattattttttaaaatttaaaccaagattttaagtaaacgataatttagatcaatttttatgaaaaggaaaaataaaaagtgcggtaattttaaagaggattattagaaaaaaaattagcgacttaaaacgtcgcccaacttaaaattattgattgttttgcacgtaatcaatcgcagattgaacagtggtaattttttcagcttcttcatcaggaatttcaatatcaaattcttcttctaaagccattactaattcaactgtgtctaatgaatctgcacctaaatcttcaacaaaagaagcttcaggtttaacatcttcttctttaacacctaattgttcaacgatgatttttttcacgcgttcttcaatactcatttgtttttcctatttgttagttttaactcataaaagagtggttagtgtatgtattttttagtaacttgcaactattttatggtctggtcgcaccacaaaataggcaatgtgaacacacacatcaaatatagttacgtacctttgcatacgctcaaggcgtaaccaagttacattgcgagcgggattttagcattatctaaaatctttggctatgattttattgcttagaaatcccccataaatcaatgtcaaattttagcttaagtataagccaccattcacgtgtaacgttgttcccgtgatataacctgcatcatcagaagctaagaaagcaacggctttagctatgtctttngcttcgcctaaacgtccagctggaacattagataagatccccgcttttkgttcatccgtaagcacttctgtcatatctgttgcaataaaaccaggagcaaccacatttacagtaataccacgtgcagctacttctttcgctaaagatttagaaaaaccaaccacacccgcttttgccgcacaatagttagtttgtcctggattacccgttgaaccaaccactgaaccaatattgatgatacgaccaaaacgttttttcatcattgaacgtaacatggctttagaaagatgatacaccgaagttaagttagtttgcataatatcaaaccattcctcatctttcatacgcatcaataaattatcgcgagtaatacctgcgttattcacgagaatatcaatatcgccaaaatcatttttaatttgttcaagtaaggtttcgatagattctttatccgttacgtttaaaactaaacctttacctttatcccctaaataagccgagatcgcctctgcacccttttcagaggttgctgtaccaattacaaatgcaccttttgaactaagttcttctgcaatcgcacgaccgataccacgggtagatcctgtcactaaagcaattttaccttgcattttttcttccttttacttacactaaaaattcttctaccgcattgaatgatgcaacatcatttacagatattgcttgtaaatcacccacaatgcgtttggttaaaccatttaatactttacctggccccacttcagcaagcactagaacgccatcttgcgccattttttcaactgtttcagtccaacgaactggactatataactgacgcacaagtgcggtacgaatttcggtgccttcagtttcagctttcacatcaacgttatttaataccgatattgttggtgtattaatttgaatattctcaagtgttaccgctaattgctcggctgcaggtttcattaatgcacagtgagaaggtacgctcacagctaacggcaatgcacgtttcgcccctgcttctttacataatgcagccgcacgctcaactgcagctttcgcacccgcaataactacttgacccggtgagttaaagttcaccgcagatacgacttcgccttcctctgcttgtttgcaagcattaataattgcttcattatctaaaccaatgattgcatacattgcgccagtgccttcaggcacagcttgttgcattaattttccgcgcaattccactaatttaatcgcatcttggaaatccaacacgccagcacaaactaacgcagaatactcacctaagctatgacctgccatcacttctggttttaattgaggaaatttttctttccatacgcgataaatagcgactgaagcagctaaaagtgcgggctgagtttgccaagttttattaagttcttcagctggaccttgttgaacaagataccataaatcataaccaagcgcatcagatgcttgtttaaatgtttcaataacgattggatattcagttgcaagatcagcaagcataccgacagtttgggagccttgacctgggaagaccattgcgaattttttcattatgttttgtcctattgttttttaattgaaaattcttcttcggtaattaaaatcgggtttcgccgatggcgagcttactttttctttgcttcgccaaagaaaaagtaagcaaaaagaaaggcgcccctacttttccttgtttcctttgttccattgaatttgccttaacggaaattttctgaactcgctacgctcaaacagacgaaaatttcctacaaattcaattccacaaaggtggaaaagaagggaacccaatttgttctttatccgatttaaagtgcggtcaaaactcaaaatattttttgttcttaaaatgaatttaaaattaaccgcactttttaaataatgctctgataaattcggggccccatataaatcacctttgcgactttcaattttcaggcaatttgcgtctgtttgagcgcagcgagttcagcaaattgccgttaagaaaattgaaacaaagcaaagaacagcgatttaactggggcgtgttttctttgcctactttcttttacacgagtaaaagaaagtgagtcgccgtcaggcgaacccctgacatttaacacaaaaagtgcggtcaatttttaccgcactttaaaatcatcaataattatatcaaatcaactaaaatctcactaacgctgaaccccaagtccaaccaccgccaaaggcttctaataatagtaactgcccacgttgaatacggccatctcgaatagcctcatctaaagcaacaggaacagttgctgcactgttattagcgtatttatctaacgttaccaccacttgcgacatatccatttctaattttttagctgttgctgtaataatacgtaaatttgcttggtgtggcacaagccagtctaaatcttttttatctaaattattggctaaaagtgtttcttccaccacatttgaaagttcacgaactgccaatttgaacgtttcgttaccttgcatctcgatatagccagatttttctataccacgttctggctgagctaaaacaagggcattatttttatctgctgaagcgtgtaaatgggtggagataattccttcttgttcactcgcttctaaaattacagcacccgcaccatcaccaaatagcacaacagtgctgcgatctgtttcatctaatttacgagaattgagatctgagcctatcactaaggcttttttcactttgcctgcacgaataaattgatcagctacgctcaaagcatagacaaagcctgtgcaagctgccgccaaatcaaaagaaatcgcatcatcaatatttaataaaccttgcacttggcaagccgcacttggataagcatgtgagtgacttgtagttgcaacaataatcagttcaatatcttgaggattaatttgagcagcttcgatcgcattttttgccgcttcaaatcccattgttgcaacagtttcatcttccgctgcgatacgacgttcacggataccagaacgagtgacaatccattcatctgatgtatcaaccattttttctaaatccgcatttgtgcgaatatggctcggcagatagctaccggtggataaaattctactattcatactcaataagataagcgattaaaaaggaaaaaatctatggactatcgccaagtaagagataagaccacaccggattattttccgatgttaaaggaatgcagatagtaatacggggaccaacgtccccgcccatcacatctaacgccaaggttagacggttcaagtgaacacctataagtaaaaaattacttattgatcactttacgaccacgatagtaaccgtctgcagttacgtggtggcgtaagtgagtttcaccgcttgctttatctactgatacagcagcagttgttaaagcatcgtgtgaacgacgcatatcacgacgtgaacgagattttttgttttgttgaacagccattggctatactcctaaatttaatttacttttgctttaaattagctaatacagcgaacgggttcggtttttttgccaattcttcaggcaatacgccaaaaacctgttcctgcgcggacacttcacagtgttcagatgaatgcattggtacaagcggcaaagctaaaattagctcatcttccaccgtgccaattaaatctatttcgccaaactcattgaactcgattggctcataaatttcgggcaagtcatcagcctgatcccaattagccactggactataagtaaactcacattccaatgtttgtttgtaaggttcgttacaacgctgacattcaagatcgacatcaatctgtactttacctttcatcaccactaatttttgtggatcaacataaaacgataatgttacctgtgcatcgctgagcacgtttaccactgattccgccaaacgctcaagctgatttgccgcataataaccaacataatcaagccgtctttgagcatcttttatgggatcaacagtgaggggtagttttaccttttgcatagggcgtgaatattacctgttgttgcgaagatagtcaaagggaaatcacattttttattggataactcaataaaggaaattatccgctaactaaaaaggttggaactataacaaaaattgctataatcacgcctctttttttaacaaggaaagataatgatgacttcaaattcttattggcaacgcttaaaagtggcatttcaatatgtcatgccacaaatttatttaactcaaattgctggctggtttgctaaacaaaaatggggcaaaataacacattttgtaattaaagcttttgcgaaaaaatacaacattgatatgagcattgcgcaaaaagaacaattttctgattacgcaagttttaatgaattttttattcgtccgttaaaagaaaacgcacgtccaattaatcaaaatccaaccgcactttgtttaccagcagacggtcgcattagtgagtgcggtcatattgacgataatcttttattgcaagctaaggggcattttttcagcctagaagacttattggcagaagataaagaattagtggaaacctttaaaaatggggaatttgtaactacttatctttctcctcgtgattatcaccgagtgcatatgccatgcgatgctacgctacgcaaaatgatttatgtgccgggtgatttattctctgtgaacccatttttagcccaacatgtaccaaatttatttgcacgtaatgaacgtgtgatttgtgtatttgatactgaatttggcacaatggtacaaattttagtgggtgcaaccatcactgcaagtattggcacaacttgggcaggcgtaattaatcctccacgccacaacgaagtgaaaacttggacttatgaaggcgaaagtgcggtcaaattattgaaaggtcaagaaatggggtggttccaacttggttcgacagtaattaatttattccaagcaaatcaagtgcgtttagctgatcatttaagcgttaatgaacctgttcgcatgggcgaaatcttggcatataaaaaataaacaggatttatttccataaatgacagaaacaaatcctgaaagtagatatttctcacttctttaaaggcagtataaccttactgcctttttcttctttcatttgaacaattaacgcattgttacaaattcctctgaacctgttggatgaattgccaccgtattgtcaaaatcagcttttgttgcacccattttgattgctacagcaaatccttgaatcatttcatctacaccaaaaccaataccatgtaaacccacaactttttcatctttacccacacaaactaatttcattttgcacggttggcgatgttgagttaccgcagtgtacatcgctgtgaaagaagatttatataccttaacattttctgcgccgtactgctcaatcgcttgcggttcagttaaacctacagtgccgataggcggatggctaaatacaacggttggaactaaactgtaatctaaatattcagtcggtttattattaaataaacgctcagaaaggcgacgacctgctgcaactgcaactggtgttaattcaatgccgttttcgataatatcgcctaccgcataaatgcctttcacattagtattttgatatttatctactttgacatagccatgttcgttcgtttctacgccagcattttctaagccaattttatctgtcgttggaacacgacccgcagcccaaataacgcaatctacggtaacatcagattgaccatcacatcttacagtaagtgaaccatctgcattttttacaatttcagatggggtagaattggtatgtaattgaattccatcttgcgcaagcacttccactaatgtttctacgattaatggatcctgattacgcattggcgcatggcgacgcactaataaatgtgtttccacgcctaagctatttaatacgccagaaagttcaacagcaatatagcctgcaccaataacagcagcacgttttggtaattcggttaatgcaaagaaaccatctgaatcaatgccgtattcttgtcctttaatatttggacgatatggacgaccaccagttgcgattaaaatatgatctgcggttacttgttcttttgtaccatcagcaagtgttacttcaatggtatgggcatcgacaaattttccgaaaccattaattacatcaatattatttttcgctaatacattattataagatgtatggatacgactaatataggcttggcgactttcaatcagttttgaaaaatcaaattttttcacttcaacatcaaaaccataatctggcgcataattgttgattgcttctgcaatatgcgcaccataaaacatcacttttttaggtacacaaccgacatttacacaagttccgccaagatgttttgcttcaatgattgcacatttttttccatagcttgctgctcgatttagagacgcaataccgccactgccaccgccaatagcaatataatcataatgtttagtcatagtttgaaccttttttaaactaaaatttttttgtattctgcctaatttttataaagaatgctataaattgatgtaattggttttatgaatattttttactcttttgaacagatgattagtttgaaatgattttatgtgaagcctagtatgtagaatgaaatagcgtgatagaaaaagaggaagattgttcaatcttcctcactgtagatatgtgattaattagaatattggtttatcgcagccgcaacttcttgatcttgataaatattgttcacaatatcattaaaagtttgagatagcactttatgaatttcatcattgcccgcattaaatacgccctcttgtgagtgcgtgacattaaatgatttattatacgaacctttcgcaccttgtacataaactgtcgcttgaattttggtattaagtttataacgaagattaccttgttctacttgcgtaccaaattcacgcacatccacagttacccacgcatttgaaccatttaattgcccaactctaaaacctttactaattaaattttgctgcatcacttgctgaaataattgtgtaacacttggggatgcatttaatttaatcagttccccgtgtttcgtataactcgcaatctcttgtattgcacggctatcttttgttgtcacagatacaacggcagttcgattaacattcattgaagcacttggtgcaggcggtgtaaatgctaatatatttgattgtgcttggcagcctgcaagaaataatgtagccgctagaatacctactgatgataatgttttaattttgtttactaatgccataatttccccataaatcaattagaattgtgctattcttacaaacttccttattaatgtatagcgtttcattttagtttttgtggagaacttataatgtcaattcaacaaattattgagcaaaaaattcaaaaagaatttcaaccgcactttttagcaatagaaaatgaaagccatttacatcactctaatcgaggttctgaatcacattttaaatgcgttattgtcagcgcagactttaaaaatattcgaaaagtacaacgtcatcagcgtatttatcaattattgaacgaagaattaaatcatagtattcacgcattagcattacatttattcactccagaagaatggaaagcacaaaatgaaactgtaccgcactcaacaaaatgtgcaggtattggtcgttaattttgttataaaaatgtaacatttttgatatatcgcaaaaagttctaacaaaaaaccctctgtttaagtagcgaaaaacagagattttcgctagaatgaggcgtttaatttagtccaaattcgatttctcggtaaaattattaactgtgaaatcaatccatttgagttttttattttgtgacattaatgtttttttagcggtttgtcacactcaaacgtgagattgcttctagggtatttttactatattagcaattgtatttttaaccttgaaaagtagtgcaaatagtatgattacaattaagaaaggtttggatctcccaattgcgggaaaaccagcacaagtaatccatagcggcaacgctgtgaatcaagttgcgattctaggtgaggagtatgtggggatgcgtccttcaatgaaggtgcgcgaaggcgatgttgtgaaaaaaggtcaagtactttttgaagacaaaaaaaatcctggtgtaatttttacagcccctgcaagcggtaccatcactgcaatcaatcgtggcgaaaaacgtgtattacaatctgttgttattaatgtagaaggtgatgaaaaaatcacttttgcaaaatatagcacagaacaattgaatacactttcttctgaacaagtaaaacaaaacttgatagaatctggcttatggacggcattacgtactcgtccatttagtaaagttccatccattgaaagtgaagcatcttctatttttgtaaatgcgatggataccaatccattagcagccgatccctctgtcgtattaaaagaatattcgcaagacttcactaacggtttaaccgtattaagtcgtctattcccttcaaaaccattacacttatgtaaagcaggcgattctaatattccaactgctgatcttgaaaatttacagattcatgattttactggtgttcatccagctggtcttgtagggacgcatattcactttattgatcctgtcggtattcaaaaaactgtatggcatatcaattatcaagatgtgatcgctgtaggtaaattatttacaacaggcgaactttattcagaacgagtaatttctcttgcaggtcctcaagtgaaagaacctcgtttagtacgtacaacaatcggtgctaatctttctcaattaacccaaaatgaattaagtgcaggtaaaaatcgtgtaatttctggctcagttctttgtggtcaaatagcaaaagattcacatgattatttaggtcgctatgctttgcaagtatcagtaatcgctgaaggtaatgaaaaagaattttttggttggattatgccacaagccaataaatattctgtgactcgtaccgtattagggccacttcagtaaaaaattgtttaattttactacttcagaaaatggtggcgaacgtgcaatggtgccaatcggtagctatgagcgcgtaatgccattggacattttacctacattattattacgtgatttaatcgtgggcgataccgatggtgctcaagagttaggttgtctggaattagacgaagaagacttggcgttatgttctttcgtttgtccaggcaaatatgaatacggttcaatcttgcgtcaagtcttagataagattgagaaggaaggttaaaaatgggtttgaaaaatctttttgaaaaaatggaacccgcgtttttacccggtggtaaatacagcaagctttatccgatctttgaatcgatttataccttgctttatacaccaggtacggtaacgcacaaaaacactcacgttcgtgatgcgttagattcaaaacgtatgatgattacggttttccttgcgttgttccctgcgattttctatgggatgtacaatgtgggtaaccaagcgattccagcgttaaatcaattaggcaatttagatcaactaattgctaacgattggcactatgctcttgcaagttcattaggtttagatttaactgccaatgcaacttggggctctaaaatggctcttggagcaattttctttttaccaatttacttagtggtatttaccgtttgtactatttgggaattgttattctctgtggttcgtggtcacgaagtaaatgaaggaatgttcgtttcaaccattttatttgccttgatcgttccaccaacattgccactatggcaagccgcattaggtattacttttggtatcattgttgcaaaagaaatttttggtggcgtaggtcgtaactttatgaaccctgcacttgctggtcgtgcgttcttattcttcgcatatccagctcaaatttcaggcgatacggtttggactgccgcagatggtttctctggtgcaaccgcactttcacagtggtcacaaggtggtcaaggtgcattgcaacataccgtaacaggggctccaattacttggatggatgcttttgttggtaacttacctggttcaatgggggaagtttctacccttgcaattttaattggcggtgctgttattgtattcactcgcattgcagcttggcgcattattgctggtgtgatgattggcatgattgcaacctcaaccttgtttaacctaattggctcagagactaaccctatgttctcaatgccttggcattggcactttgttttaggtggatttgcattgggtatggtatttatggcgaccgatcctgtttcagcatcttttactaatactggtaaatggtggtacggtgcattaattggcgtaatggctgtattaattcgtactgtaaacccagcctatccagaaggaatgatgttagcgattttatttgcaaacttatttgcaccgattttcgactacatcgttgttcaagcaaatatcaaacgtcggagagcaagaacaaatggctaagtttaataaagacagcgtaggcggcacaatccttgttgtgctactactgagtttagtttgttccattattgttgctggttccgcagtaatgttaaagcctgcacaagaagaacaaaagttactcgataaacaaaaaaatatcttaaatgtagctggtcttttacaagaaaacacgaatgtaaaagaaacttatgcaaaatttatcgagccccgtttcgttgatttagcaacgggtgaatacacacaacaagcagatgatagccaacaagcaattcctgctgatgcggataaagcacgtattcgttctcgtagcaaaacaactgaagtttatcttgtaaaagatgaacagggtcaaactcaacaagttattttaccaatttatggcactggcttgtggtcagtgatgtatggcttagtatctgttcaaccagatggtaatactattaatggaatcacttactatcaacacggagaaacaccgggattgggcggagaaattgaaaatccaaactgggcaagtctatttaaaggtaaaaaattatttgatgagcaacatcaacctgccattcgtattgtgaaaggtcaagctccacaagatgaacatagcattgatggtttatctggtgcaactttaacaggtaatggtgttcaaggtacctttaattattggttcagcaaagatggctttggtccatatcttgaaaaacttcattcaggagcaaactaatgtctggaaaaacaagttataaagatctgttgttagcgccaattgctaaaaacaaccctattgcattgcaaatcttagggatttgttctgcattagctgtaacaacaaaattagaaactgcttttgttatggcgattgcagttaccttagtaactggattatcaaacttatttgtttccctaatccgcaattatatccctaacagcattcgtattattgtacagctcgcaatcatcgctcgcttgttatcgtagtggatcaaattctaaaagcctatgcttatggtttatctaaacaactttcagtattcgttggtttgattattactaactgtatcgtaatggggcgtgctgaagcatttgcgatgaaatcccctccagttgaaagttttgtagatggtatcggaaatggcttaggttatggttcaatgttaattatcgtagcatttttccgtgaacttatcggttcaggtaaattatttggtatgacgattttcgaaactattcaaaatggtggctggtatcaagcaaatggtttattcctacttgcaccaagtgcattctttatcatcggatttgtgatctggggattaagaacttggaaaccagaacaacaggagaagtaatcaatggaacattatattagcctatttgttaaggcagtcttcattgaaaatatggcactttctttcttcttaggaatgtgtactttcttagcggtatctaaaaaggtgtcccctgcgtttggtcttgggattgcggtaactttcgttcttgggatcgcagtgccagtaaaccaattaatttatgcaaatgtactaaaagagaatgctttaattgaaggtgtagatttatcattcttaaacttcatcactttcattggggttattgctggtttagtgcaaattcttgaaatggtattagataaatttatgccatctctttataacgcattagggatttcttacctttaatcgcagtaaactgtgcgatctttggtggggtatctttcatggttcaacgtgattacaatttccctgaatctatcgtgtatggtttcggctcaggtttaggttggatgttagcgattgtagcgcttgctggcttaacggaaaaaatgaaatacgctgatattcctgctggattaaaaggtttaggtattacctttatctctgttggtttaatggcactaggctttatgtctttctctggtattcaattataaggagtgtaatcaatgagcgattcagtaattcttgcactcggtattgccgcattcacggttattgtattagtgttagtggcaatcatcttatttgcgaaatcaaaattagtcgattctggtgatattactatcgacatcaatgacgatcctgaaaaagcgatcacattacctgcaggtggcaaattattaggggctttagcaagtaaaggtattttcgtgtcttctgcttgcggcggcggtggctcttgtggtcaatgtattgttaaagtgaaaaatggtggcggagaaattcttccaaccgaactttctcacattaacaaacgtgaagcaaaagagggatatcgcttagcttgtcaagttaatgtaaaaggtaatatggaagttgaacttccagaagaaatcttcggcgtgaaaaaatgggaatgtactgttatttctaacgataacaaagcaacctttatcaaagagcttaaattggctattcctgaaggcgaggaagtgcctttccgtgcaggtggttatatccaaatcgaagctgaaccacatgtggtgaactataaagatttcgatattccagaagaataccacgaagactgggataaatatgatttatggcgttatgtctctaaagtggacgagcatattatccgtgcttactcaatggcttcataccctgaagagaaaggtatcattatgcttaacgttcgtattgcgactccaccaccacgccaacctgatgcgcctccgggtcaaatgtcttcttacatttggtcattaaaagcaggagataaagtcacaatttctggtccatttggtgaattctttgcgaaagaaactgatgcagaaatggtatttatcggtggtggtgcgggtatggctccaatgcgttcacatatcttcgaccaattaaaacgtttacattctaaacgtaaaatgtcgttctggtatggtgcacgttctaaacgtgaaatattctatcaagaagactttgaccaattacaagctgaaaatccaaactttgtatggcacgtggcactttcagatgcattgcctgaagataattggactggctatacaggctttattcacaatgtactttatgaaaactacttgaaaaatcatgaagcaccagaagactgtgaatactatatgtgtgggcctccagtgatgaatgcagctgtaattaaaatgttgaaagatcttggtgttgaagatgaaaacattttattagatgactttggtggctgattttagttaatcaattcatcataaaagctgcccgcactttgtgataaagtgcggncsaaatttaagatgtttttaaacattttctatgattacaggtaagttttgttgagtttgccagtaattcaccaatttaggaaatccagatgaaaaaattaataagcggtatcatagcggtagcaatggcattaagtcttgctgcttgtcaaaaagaaacaaaagttatctctttaagcggtaaaacaatggggacaacttatcatgttaaataccttgatgatggttcaataacagcaacatctgaaaagacgcatgaagaaattgaagcaatcttaaaagatgtaaacgcgaaaatgtccacttacaaaaaagattcggaattgagccgcttcaatcaaaatacccaagtgaacacaccgattgagatttcagcagattttgccaaagtattagctgaagcgattcgtttaaataaagtgaccgaaggcgcgttggatgtaactgttggccctgtcgtgaatttatggggatttggtcctgaaaaacgccccgaaaagcaacctacaccagaacaattagctgaacgccaagcgtgggttggcattgataaaattaccctagatactaacaaagaaaaagctacattaagtaaagcacttcctcaagtttacgtagatttatcgtcaattgctaaaggctttggcgttgatcaggtggctgaaaagttagaacaattaaatgctcagaattacatggttgaaatcggcggtgaaattcgtgcgaaaggaaaaaatattgaaggtaaaccttggcagattgccattgaaaaaccaactacaacaggcgaaagagcggttgaagcggtcattggattaaacaatatgggaatggcaagttctggcgattaccgtatttactttgaagaaaatggcaaacgctttgcgcacgaaattgatccgaaaacaggttatccaattcagcatcatttagcctcaattacggtacttgcaccaacctcaatgactgcagatggcttatctacagggttatttgtgctgggggaagacaaggcgttagaagtggctgagaaaaataatcttgccgtttatttaatcattagaacagataatggttttgttaccaaatcatcctctgctttcaaaaaattaacagaaacaaaagaatagttatgcaaactttattttttactttaatcgctttcgtcgcaattatattgttgatgtctatcggatttattatcaaaaaacaaagtttaaaaggcagctgcggtggtttatctacccttggtattgccaaagcttgcgattgtgataaaccttgcgacacgcntcaatcaaaattagatgcaggcgatgracaagcgaaagctgaatatgagcaaaaatttgcgaaaaaagatgatgactcgcaattttatcaagtgaaataacttgctcaaaaatgaccgcactttatgtgcaaaataaaattaacggcaaaattattttgccgttttctcattcaatgaccaatgtgcttcgccttaaccgaagttacgggagaactatgttaatttcaaatacttataatcaacactttcctcaattgacgcaagagcagcttgcgagaaatgcgacaaaaaaagtcatttgtggtatgtctggtggcgtggattcttctgtgtcagcgtttattcttcaacagcaaggctatcaggtggaaggcctgtttatgraaaactgggaagaagatgatgatacggattattgtactgccgcagctgatcttgcagatgctcaggctgtatgtgataagttggggatcaaactacataaaattaattttgcggcagaatattgggataatgtctttgagcattttttaaccgaatataaagcagggcgcacgccgaacccagatattttgtgtaataaagaaattaaatttaaagcatttttagaatatgcagctgaagatctcggtgcagattatattgcaacagggcattatgtacgtagagcgggagataatgaaaatgcaaaactattacgtggtttagatcccaataaagatcaaagttattttctttatactttaagccataaacaagtggggcaaagtttattccccgttggtgaaatcgagaagcccattgttcgtgctattgctgaagatcttggcttaattacggcgaagaaaaaagattctacagggatttgttttattggtgagcgtaaatttaaggatttcttagcacgctatttaccagctcaaccaggtaatattcgcactgtagatgatgaaattattggtcgccatgatggattaatgtatcacacattgggacaacgcaaaggattaggcattggtggtctaaaaaatgcgggagatgaagcttggtatgtagtagataaagatgtagaaaataatgaacttattgtcgcacaaggtcacgatcatcctcgtttattttcaaaaggattgattgccagccaattacattgggttgatcgcgaaccaattcgagagtcattacgttgcacggtgaaaacgcgttatcgccaacaagatattccttgtgtgattgaaccaattgatgatgaaaccattcgagttatttttgatgaacctcaatcagcagtaaccccagggcaatctgccgtattttaccttggcgaagtttgtttgggtggcggtattatcgcagaaagaatataaaacaaagatgactaaaagcgcgtaaaatgcgcttttaaactatttattcaaaccaaatgacgctcgccattcgtcccgtttgattgtccctgcgataagaaaagaacttttctttttcgttgaatgtacagtgatttccaccataaatttgcgtaatacctagattgtttaatcgctgagttgcaatttgataaagattactcaggtatttaccttcttcgattgcatcaggttgaaaggcgagtttggctttttcatctactacaacaaacttttctacaacatcaatcccaacttgaaaggcctttggacctattgcagggccaaaccacgcgataatatcttcaggtttagcttgaaaatatttcactgtttcttctagtacaccatcgcataaaccacgccagccagcatgtgttgcagccacttcattgccagatgttgtagtgaatagaactggcaaacagtctgccgtcataacaacgcaaacttgattgggaacatttgtataaactgcatccgcttcaagattttgtcctgaataaggtaattgaatcactcgagtactgtgtgtttgagttagaaatataggtgtttgtggcaaaccaaatttttctactaataaagtgcggttggtttttaccgcacttttgttatcaccgacatgatcgcctaagttgaaactcaaataaggcgctaagctcacacccccttcacgagtagtggtaaaggcatgaatattctttggaacattccaattggggttaattgcttgcatattaataatctaactcatcttgatgttcgagatagtcggctttgagggcattaagcaattcaacgaaatcatctggtaatggtgcataccattccatcatctcccctgtgattggatgagctaagcgtaacatgaccgcatgtaaagcttggcgtttgaaattacgcaatacttccataaagtcttcactcgcattttttggtggacgagggcgtccgccataggtttgatcgcctagcagtggatgggcaatatgtgccatatgaacgcggatttgatgggtgcgccccgtttctaaacgtaaacgtaaacgggtgtagttacggtaattttccataatacgatagtgggtaacagcgggttttcccattggatgaaccgccattaaagtacgtttggttgcatgacgagccataggttgatctactgtgccacctttagtcataatgcctgaagcgactgcttcatattcgcgcgtaattttacgtttttgtaggtcacgtactaacttagtttgagcaggaatggttttagcaacaaccattagacctgttgtatctttatctaatcgatgcacaattcctgctctcggtacttctacaatcggcggataatgatagagtaacgcattgagcacggttccatttggattgccagcaccagggtgtaccacaagatcttttggtttgttaatcacaataatatcatcatcttcatacacgatattcaatggaatattttctgcttcaaaacgtgtttcatcttccacttcaacaataatctctattctctctcctccaagcactttctcacgcggaatattagtaatgcggtcgttaagttttacgagatcggcttcaatccatgtttttaatcgggaacgagaatattcagggaacaactctgcaagtgtttggtctaaacgttgtcccatttgttctggctgcacttcagccgaaagggtaatttgtggcataaatagctctcaaaaattttaaaagttggcttattgattaatgttctatacaatagcggacaattgtatcttatttattggttttcgtaaaaattaaggaaaaaacaatgcgtaaaataaaatctttggcattgcttgccgtggcagcattggttattggatgttcaagtggttcaaaagatgttgaacaagcatcggtaaatgaattatacacaaaaggtacaacatcattacaagaaggtagttactctgaagccattcgctatttaaaagcgacgactgagcgttttccaggtagcgtttatcaagaacaagcaatgttagatttaatttatgcaaattataaaacacaagattatacgcaagtattattgatggtagatagctttttacatcaatttacacaaagcccaaatcaagcctatgcggtatatatggctggcttaactaatgcagcaacaggcgataatttcattcaagatttttttggaattgaccgtgctacacgtgaaacaacctctatgcgtaccgctttttctaatttccaaaacttagttcgtgtattccctaatagcccttactcacaagatgctttagctcgtatggcttatattaaagatgcactggctcgtcacgaattagagattgcaaaattctatgcaaaacgtaaagcgtgggtagcagttgcaaatcgtgtggtaggaatgttaaaacaatatcctgatactaaagcaacttatgaaggattatttctgatgcaggaagcttatgaaaaaatgggtttaaccgcattagcaaatgatactcaaaaaattattgatgcgaataaagataaaacttttgcaccaattgaaaaaccaaacgagccagacttaaaagtgccagcagtaaaatagcaataactgcagaaaaatcgaatactctctgcaccctaaaaattgaataaaatttaaactaattaaggtgcagatttttttattttttatcaactgaaaatgctttaccataatttgcacaaataatctgagcagcattataaagcgttgtatcaggtgttaaacttaacgtatgtttcttttgctttttaggtgctgcccgcaaaccctgtccccaaaattcatcatagaaatcagttcgtatttgagttaaatgataatttgcacaattcaaaatcttatactgacgaacagaacgtgcataacgtttaggctcaggataaacatacaatcccctatctaaattcaccacagcatcaaaatgtacaatttgtggctcttggttatccacccagatcgattcactatcgatgtaataattcacattctttaccaaacgtatatatccgcttcgtacatcagtcggcggtgccagcttcacatcattttgttcagccttttggatttgagcagaacaagcggtaagtaacccaagtgataatgttaaaataatttttttcattatttactccttatgttagctgacatttattctagaattttacagtgtgtccataaccttctaggattgttttaatatgttctaaggattctttagttggcggtaatacattttcaagctcataatctaacccaagggttttccatttatgcacacctaatcgatgataaggaagaagttcaactttttcaatattggtcataccttcaataaactgacctaataaatgcacatcgtgatcgctatcagtataaccaggaaccacaacataacgaatccaggtatgttgattacgtttttgcaaatattttgcaaattcaagggtacgtttatttggcaccccaataagattttgatgaacttgatcattaagttcttttaaatcaagtaaaacaagatctgttacatctaataattcatcaataatatgatcataatgacgtacaaaaccatttgtatctaagcaagtattaatcccttcctctttacaagcacggaaccaatcgcgtacaaactctgcttgtaacacagcctcgccaccagatgctgtgacaccaccgccagtagcattcataaaatggcgataagtcacgacttctttcattaaatcttcgacactgatttctttaccaccttcaagatcccaagtatcacgattgtggcaatatttgcagcgcatcaagcagccttgcataaataaaataaaacgaatacctggcccatctacagtgccacaggattcaaaagagtgaattcgtccaagaactgacatacataaatttcctaaaattagatatagctaaattttaccaaagatttagtctataaaaaatgagcctgatttaaatcaggctcatacatattatgttcccgccaaagtgcggtcaaaaataaacatgtttttacattgactctgtgaaagttctagtaattacgtcttgttgttgctctttagttaaagagttaaaacgtactgcgtaacctgatacacggatagtcaattgtggatatttatccggattttccattgcatctaataacatttcacggtttaacacgttcacatttaagtgttggccaccttcaaccgttgcttcgtggtggaagtaaccatccattaagccagcaaggttgcgacgttgtgcttctgcatctttacctaaggcatttggtacgattgagaaggtataagaaataccatctttcgcgtaagcaaatggaagtttagctacagaagttaatgatgctaccgcacctttttggtcacgaccgtgcattgggttcgcacctggtccgaatggtgcaccagcacgacgaccatcaggggtgttacccgttttcttaccataaactacgttagaagtaatggttaatacagattgtgtaggcactgcattgcggtaagttttaagtttttgaattttcttcataaaacgttcaactaagtcacaagcgatgtcatcaacacggttatcattgttaccatattgtggatattcaccttcgatttcaaagtcgattgctacgttagttgcaacaacattgccatctttatctttgatgtcgccacgaactggtttaactttcgcatatttgattgctgaaagtgagtcagccgcaacagaaagacctgcgataccacaagccatagtacggtatacatcacgatcatgtaatgccattaatgcggcttcgtatgaatatttatcgtgcatatagtggattacgtttaaggcagtcacatattgttttgccaaccaatccataaagctatccatacgagtcattactgtatcgaaatctaatacttcatcagtaattggtgcagttttcggacctacttgcatacctaatttttcatcgataccgccgttgattgcgtataacaatgttttcgctaagtttgcacgtgcaccgaagaattgcatttgtttacccacaatcattggtgatacacaacatgcgattgcgtagtcatcgttgttgaagtctggacgcattaaatcatcgttttcgtattgaactgatgaggtatcaatcgatacttttgcacagaaacgtttgaagttttcaggtaattgttcagaccaaagaatggttaagtttggctctggagaagtacccatgttgtaaagggtgtgtaaaatacggaatgtatttttggttactaatgtacgaccatctaaacccatacctgcgatggtttcagttgcccacattgggtcaccagagaataattgatcgtattcaggtgtacgtaagaaacgaaccatacgaagtttcataactaagtggtcaactaattcttgcgcttcagtttcagtaatttttcctgcttttaaatcacgttcgatgtacacgtcaataaaggttgcggtacgaccgaatgacattgcagcaccattttgtgattttattgcagcaagataagcaaagtacatccattgaatggcttcttgagcattagttgctgggttagaaatatcataaccatagcttgctgccatttgttttaattgacctaatgcacggtgttgttctgcgatttcttcacgtaaacgaattgttgcttcaagatttacgccatcttctaaatctttttgtaaagaagagaattgtgcgtatttatctttcattaagaaatctacaccataaagtgctacacgacggtagtcaccgatgatacgaccacgaccataagcatctggaagaccagttaataccccagatttacggcaacgtaaaatatctggcgtgtaaacatcgaatacaccttggttatgtgttttacggtattcagtgaagatttttttcacttttggatcaagttcacgaccataaactttacaagaaccttccaccattttgataccaccgaatggcataatggcacgttttaaaggttcatcagtttgaagaccaacgattttttctaaatctttgttaatgtaaccaggtgcgtgagagataatggtagatggtgtatgttcatcaaaatctaatggcgcgtgagtacggttttcaattttaataccttccatcacagattcccaaagcttggttgttgcttcggttggacctgctaagaaagagtcatcgccttcataaggggtatagtttttttggataaagtcacgtacattgacattttcttgccaatcgccaccagcaaaaccagcccacgccaatttttgcatttcattaagttctgacatagtcatttcctttgttaattaataaataaatctttaatgtgttttggttaaataacgttggaatacaccaatacaaattgccccgccgacaatatttcccaacgttacagggattaaattcttcacgatgaaatggtacaaatctaaatctgcgtatttcatcggatcaacaccgatttgttgccaaaattcaggtgtactaaaatgtgcggtaataattcccatcggaatcataaacatattagccacacagtgttcaaatcctgacgcgacaaacaaaccaatcggcataatcataataaatgctttgtctgtaacagtcttaccagaataagacatccaaaccgccacacacaccataatgttacataaaatacctaggttaaaagcttcaaaccaagtgtgatgaattttatgttgggcggttgcaagaattgttaaaccccattggccatttgctgccattgtttgtccactaaaccaaataacagccgcaataaataaaccaccaacgaagttgcctaaatacaccacgatccaatttcgaatcatttgtgtcgtggtgattctaccgcctacacgggcgactaaagttaaagtagaagaagtgaataattcagatcctaaaatcaccaccataattacgcccaaggagaagactaatccacctactaacttggttaatccccaaggtgcgcctgcactagcagtttgtgttgtcgtgtaaaatacaaaggctaaggcaatacaagcaccggcactaataccggacataaacgataaaaatggacgtttatttgctttataagttgctgtattttctgcataatccgttgcttcaacaggtgtgagcgcaacagaagatagtttttgattttctgatgccataatcaaactccaactattgacattgaaaaagttgatgaaaatttaatacttttaacaagtttacgactacaaatacttctataattggtgctattttactctcctcccctttcattgcaaagaaaagcaaaaattatttcaacaaactttgatattttgcaaggtttgtttaattaaagacaaaattcccatattaatattcgctcaatttcatacattcagagtaagtaaagtacttaatttgaaacttgttttattcgcgtaataccgtgaattcccccagataatcatccacttttccaaaaccttgattattcacaacaggcaaattcataattttttcaaacgaaccagattaagtgtatagacttgctattttgagtaattaatagcattattttgatctttttgaagaaaaaggcgatctttgtcataaaataatgatttaagtgcggttaaaatttggttaattttaagtgcacttctttatacaggagcagattatgtattatggtttagatattggtggcacgaaaatagagcttgccgtattcaatgaaaaattggaaaaattatattctgaacgggtgccaacacctaaaaccgactatgaagaatggcttaacacgattgtggatttagtgaatcgtgctgatgaaaagtttggtgaggtgggcaccgtaggtttgggcgtacctggttttgttaatcaacaaactggattagccgaaattgccaatattcgtgtggcagataataaaccaattttatgcgatttgtctacgcgtttgggccgtgaagtgcgggcagaaaatgacgcaaattgttttgcgttatctgaagcatgggatacggaaaatcagcaatattcgactgtacttggtttaattcttgggactggttttggtggtggctttgtcttaaacggtaaagttcattcaggtcaagtgggaatggcgggagagcttggtcatttacaattaaattatcatgctttgaaattattgggatgggataacgccccaatttatcaatgcggttgcggcaacaaggcttgtttggataattatctgtctggtcgcggttttgaaatgctttatcaagatttgaaaggcgaaacattatctgctcgtaaaattattaatttgttctatcaaagcaatgaaagtgcggtagattttgtgaatctttttgttgagttggcggcgatttctattggcaatatcattacggcatttgatccgcatatgattgtgttaggtggtggattatctaattttgattacctttatgaggctttaccaaaagcncttccgcctcatttgatgcgaaaagcaaaagttccgccaattaaaaaagcgaaacacggcgattctggtggtgtgcgtggtgcggcagcgttgtttttaaccaaataattcaacaaactagtggggcgtattcaaataatacgccctttattttggaaaatatttagaatattgtgaatttattagattttttcttgtttgtgtttctttctttagagaaattattaaaaaatctcgccttttcattgaaaagccatacaatcaaattatttatcgcttgagggatgattatggaatttgaattttcaaaaatgttagaagaagtgctaacttggatagtcgcacaccttgatggacctttatgggatgccaccattattattttgcttgggactggtctattttttaccattacaacaggatttgtgcagttccgtttattcccagcaagccttcgtgaaatgtggtttggtcgttcggtggaggggagttcattaacacctttccaagcgtttacaacaggtcttgcgagccgcgttggtgtgggtaacattggtggggttgcaacggcaatcgccttagggggcgaaggcgcagtgttttggatgtgggtaacggcatttattggtatgtcgagtgctttcgctgaatctacccttgctcaattatttaaaattcaagataaagatggatcattccgtggcggccctgcttattatattgtgcaaggtttaaaatcacgttgtatggcagtggcttttgcgcttgcattaatttttacatttggttttgcctttaattctgtgcaggcaaactctattgttgaagcaaccagcaatgcgtggaattggaaaggggaatatgtcggtatttcattagtaatttttaccgcacttattattttcggtggcgttaagcgtattgcgattatttcgagcaaccttgtaccaatgatggcacttttctatttgattatggcggtaattattcttggcatgcatattgatatgatcccttccgtgattcatcgtattgttcaaagtgcatttagttttgatgctgccgctggcggaatgtttggtgcattggtatcgaaagcaatgatgatggggattaaacgtggtttattctcaaacgaagcagggatgggatctgcgcctaattcggctgcagcagctcacgttaagcatccagttagccaaggtttagtgcaaatgctcggggtgtttgttgatacaatgatcgtttgtacttgtactgccgttattattttgctttcgaataattatggtagcgaaacgctcaaaagtatctctcttacgcaaaatgctttgcaataccacataggtgaatttggggcgcatttcctggcgtttatcttattgttattcgcttattcttctattattggtaactatgcttatgcggaaagcaacatccgttttatcaagaataaaccttggttggtcttgttgttccgtttaatggtgctatttttcgtgtatttcggtgcggttcgctctggtaatgtggtgtggaatttcgcagatacggtgatggctgtcatggcaatcattaacttgatcgcaattttgatgttgtcgccaatcgtatggaaattaatgaaagattatcaacgccagcttaaagaaggaaaaacgccagagtttaaaattgatgaataccctgaattacgtaagaaaatatttgattcccgcatttggaaataaagataaaatggctagaaagagattatctacctttccaaaaagagttagattattatttaaagaaattttttgatattgtttcaggcttggttcttctagttcagactgaataaactattgccggcactttttaccgccctcgtgccggctatcccaaactgctttgaaaactgaccgctctttagcttacttcaaaaattccgcatgataggcaatatgctcgccaataaaactggcgatgaagtaatagctgtgatcatagcctttatggaagcgcacatcgactggctgatttgccactcgacaggtttctataaaatcttcggtacgcaattgtgtcggtaaaaactcatcttccaagccctgatcaatgcgcataccttgcactttatagccttgttgaatgagcgagctggcatcatattgctgccatttttcacgatcttcccctaaataggcagaaaaggctttttctccccaaggcacaaggcttggcgacaaaatgggcgaaaaggcagaaacgctttgataacgttcccgatttcgcagtgccaataccaatgcaccgtgtccacccattgaatgtcccataatggaacgtttgccgttggtagggaaatttgcttcaatcaaatcaggcaattcattcaagatataatcatacatttgataattcgtcgcccaaggctgctcggtcgcattaagataaaagcccgctccctgccctaaatcgtaagccgcatcattcggcacttgctctccacgagggcttgtatcgggagcaacaacaatcacttgatgttctgccgcgtaacgctggaagcctgatttggtaatgaaattttgctcagtacaagttaagcctgaaagccaataaatcacaccaagcggtcgattttctggattatttggcaaataaacggcaaatttcatttcacattgaagtgtttgagcattatgcgcccaaacttgctgcgaaccgccaaaaatttgatgttgttcaattagtttcatagcgtaccttagtagtgaataacagtacggattgatttaccttcgtgcattaattcaaaggcttcattaattttatcaagtggcattgtgtgagtcacaaacggttctaactggatgtcgcctttcattgaatcttccaccatttgcggaagttcagagcgacctttcacgccaccaaatgccgaacctttccaaacacggcctgttaccaattggaacggacgcgttgaaatttcttgtcctgcacccgctacgccgatgataatggattgtccccagccacggtgagcactttctaatgcttgacgcattacgtttacattaccgatacattcaaaggtatggtcaatgccccatttattaatatctaacaacacatctttgatcggcttatcgtaatcattagggtttaaacaatccgttgcaccaaactgttttgccaactcaaattttgcaggattggtatcaatagcgataatgcgacctgctttggcttgacgcgcaccttgcactaccgctaaaccaatcgcacccaagccaaacacggcaacagagtcgccttcttgtacttttgctgtattatgcaccgcaccaatacctgtagtgacaccgcagccgagcaaacacacttgttcgtggttcgcttcagggttgattttcgccagtgaaacttccgcaacaactgagtattcactgaaggttgaacagcccatatagtgatagatcggctgaccttgataagaaaaacgtgtcgtgcaatcaggcattaagcctttaccttgcgtgtcacgcactgagacgcataagttggttttacccgagcggcaaaactcacattcgccacattcagctgtataaagaggaatgacgtgatcgcccggttttacgcttaacacaccttcgccaaccgcaacaaccacacccgcaccttcgtgtcctagcaccacagggaataccccttcaggatcgcttcctgataacgtaaacgcatcagtatggcaaacgcccgtgtgagtgttgcggattaacacttcacctttgcgtggcatttctacgtcgatttctacaatttgtaagggttgatttggggcgaatgctaccgccgcacgagatttgatggttgaattgatttgtttaatttccattgtttttcctcttaattcattgacaaagttgccttacgtaagcaagatagcaacagtttacactttagagttcactctaaagcaagtgtttttttatcatttttgtttaaagggaataaaaagtgacttacaccaccgctaaagctgctgaaaaaataggcatttccgcctacaccttacgcttttatgacaaagaaggcttgttacctaatgtcggacgtgatgaatacggtaatcgccgttttaccgacaaggatttgcaatggttgagtttattacaatgcttgaaaaatacaggaatgagcttaaaagacatcaaacgctttgcggaatgtaccatcattggcgacgatactattgaagaacgcctttccttatttgaaaatcaaacaaaaaatgtaaagtgtcaaattgccgaattaaaacgttatttagatttgcttgaatacaaattagcgttttaccaaaaagcgaaagcactaggctcggtaaaagctgtgaatttaccgcaaattcctgaaacgagctaaaagggtaaaagtgttcacatcacagaattagaagaaaaatacaatttttagagatagataaattttaacttttttattacataaataagttaaaaatcaggttttgtgatcaagatcaggataacataaaaataatctccgatagctattgttctaaatggctaaaaagagtatattccgagccaaattttttcttttttacagaacggagtttattatgtttggtttatcccccgctcaactgattattttattagtcgttattttattgatttttggcacgaaaaaattaagaaatgctggctcagatcttggtgcagcagtgaaaggtttcaaaaaggcgatgaaagaagatgaaaaagtaaaagatgcggaatttaagtctatagataatgaaacagcgtctgcaaaaaaaggaaaatataaaagagaaaggaacaggcttaatccgtgtttgatattggtttttcagaacttattttactaatggttttgggattggttgtattaggcccgaaacgtttgcctatagcaattcgcactgtaatggattgggtaaaaacaattcgtggtttagctgctaacgttcaaaatgagttgaaacaagagctaaaattgcaagaattacaagatagtattaaaaaagcggaatcccttaacttgcaagccctttcaccagaattgagtaaaacggtggaagaattaaaagctcaagcagataagatgaaagcggagctagaagataaagcagctcaagctggtacaacggtggaagatcaaatcaaagaaatcaaaagtgcggctgaaaatgcagaaaagtctcaaaatgcaatctcagttgaggaggctgcagaaactttatctgaagcagaaagaacacctacagatttgaccgcacttgaaactcacgagaaagtagaactgaacacacatttatctagctattatcctcctgatgatattgaaatcgctccagcgtcaaaatctcaatcttcaaaaactaaatcatagcgagtttttatgagtaatgtggatgaatctcaacctttaattacgcaccttgttgaactaagaaaccgtttattacgctgtgtgatttgtgtagtgttggtttttgttgctttggtgtatttttccaatgatatttatcattttgttgctgcacctttaacggctgttatgccaaaaggcgcaacaatgattgcaaccaatattcaaacgcctttctttacgccaattaaattaactgcgattgttgcaatttttatttctgtcccttatttgctttatcaaatttgggcttttattgcacctgctttatatcagcacgaaaaacggatgatttatccgttgttattttccagtacgattttattttattgcggtgttgcttttgcttactatatcgtctttcctcttgtattcagcttctttacacaaacagccccagaaggcgttaccatcgcaacagatattagtagttatttagattttgctttagcgttatttttagcttttggcgtttgttttgaagtgccaattgcgattattctactttgctggactggtattaccactgtaaaggctctttccgaaaaacgcccttatattattgttgcggcattttttattggtatgcttttaacgcctcctgatgttttttcacaaactttgcttgccataccgatgtgcttgctgtttgagctcggtctattggtcgctcgattttatcaaccaaaagacgacgaaagtgcggttaaaaataatgatgaatcagaaaaaacacaatgatgaactgaattgttaatcgtatgggggctttgcccccgtttttattatattgatataaccctaattttgttttttcataaaacatattttcgtagtgatttactagaaatatgatttgtaatctgctctatatttttattgaaaatatcattacctgatggttttctgtcgttttttattttttatctaataaatacgatattttttagataatttctttactttttccttttctttaaatttcctttataaaaatggttgcaagattaaattagccattgcatattgtctatgcgcctcacgaggcgaatacaataaaaatacaatacacacaacatcaacaaagagggaaattcattatgtcaaaagttgcttccttagacgcatttttaacaaaagttgctcaacgcgatggttatcaacctgaatttttacaagcggttcgcgaggtattcacatcaatttggccttttttagaagccaatcctaaatatcgttcagaagcattattagaacgtttagttgagcctgaacgtgcatttcaattccgtgtggcgtggactgacgataaagggcaagtgcaagtaaacagagcatttcgtgtacaatttaatagtgccataggcccatttaaagggggaatgcgtttccatccatcagtaaatttatctatcttaaaattcttaggttttgagcaaatctttaaaaatgctttaacaacattgcctatgggcggggcaaaaggcggttcagattttgatcctaaaggcaaatctgatgctgaagttatgcgtttttgccaagcattaatggctgaactttatcgtcacgtaggagctgatacagatgttcccgcaggcgatataggcgtcggtgggcgcgaagttggctatttagctggctatatgaaaaaattatcaaaccaatcagcctgtgttttcactggtcgcggtctttctttcggtggtagtttaattcgtccggaagcaacgggatatggattaatttattttgctcaagcaatgcttgctgaaaaaggcgatagttttgcaggtaaagtagtttcagtttctggttctggtaatgtagcacaatatgctattgaaaaagcattatctcttggtgcaaaagtagtaacttgttctgattcatcaggttatgtttatgatccaaatggatttactactgaaaaattagccgcacttttcgatattaaaaatacaaaacgtgggcgtgtgaaagattatgcagaacagtttggtttgcaatattttgaaggtaaacgcccttgggaagtgcaagttgatattgcgcttccttgtgcaactcaaaatgaattagaactttctgatgcacaacgtttaattaaaaatggtgtgaaattagtggctgaaggtgcgaatatgccaacaacaattgaagcaacagaagcattactagctgcagatgtattatttggcccgggtaaagctgccaacgctggtggtgttgctacttctggtttagaaatggcacaaagttcacaacgtttatattggacagcggaagaagtggacgctcaattacatcgcattatgttagatattcacgcaaactgtaaaaaatacggcacaattgaaggtcaagaaaacattaactatgttgttggggcaaatgtagcaggctttgttaaggtggctgatgcaatgttagcccaaggcgtttattaacaaataaaaaagttaaactaaataaccgcactgtaataaagtgcggttatttttttaggatgaaatttgaatataagaaagcgacattttgtcgccttagatattatttattttgaattgttttcgtcacaatgattaatatcactgcatttgccgtaaagatacacgttatgcgtttttaattttatgccgtatttttcactgatttcacgctgacgttgttcaataatattatccgtaaattcaaatactttaccgcaatcttcacaaataatatgatcgtgatgttctgttggagcaagctcaaaaacggatttatttccctcaaaattatgacggattacaatatgcgcttcatcaaattgattaagcacacgataaactgtggctaatccaatttcacaaccttgttccaggaaaattttataaacatcttctgcagaaaaatgttcatttttatgattttgcattaaagcgagaatagttaagcgaggctctgtaatttttaatcccacttttttgagtaatttaatatttccttcagacataattttccttcctattatgcacaaaatgctaagccaattcagctaagcacatttcatcataaatttgtttacaccatttttctacacgctctgcggtaagctctggttggcgatcttcatcaatacataatccgatgaaagtgccatcttccaataaggctttcgaagcttcaaaattatagccttctgttggccaatttcctaccacaattgcaccgtgtggctctataatatcgcgcacagttccgatagcatcacagaaataatctgcataatcttcttgatcgccacaaccgaaaatacctacaagtttatctgtaaaatcaatttcttcgagtgttgggaaaaagtcatcccagtctgcttgtgcttcgccgtaataccaagttgggataccgaaaagcaagaaatcgtatgcttcaatatcttctttgctacttttggcaatatcacgaatatcaattaaatcactacctaattgtttttggatttgttttgcgatgttttcagtatttccagtatcactaccataaaaaagaccaactattgccatttttatttccttttttatattaaatttaatctattgattataaggcttatccaaatttggcgaactatatcataaaagcattctcacttaaactacttaattcttatttagaaatcgtttaattgcacgaataacaaaatcaggtttttcggcgtgaacccagtgtccactgccattaatcgtaaaggcagttgcattaggaaattgttctagaattttttcgctattttctatttttatataagaggaatttccacccttaataaaaagagttggcgtaaatacacgtactttttcccaatccataatattggcataattgttaaaaagcgcggtaagattaaaacgaaaacaatcagctgaattaacatcaaaagatttcaacataaattgtacaacgtcttcatcattaatttcttgttttaaaatcggtttggcttgctgacgattttcaggctttgcattttttaccgcaaataggccattaaaaacatctttatgaccaaatccctcataaggcataggcgacatatcaattacgattaatttttcgactaattctgggcaaagtgcggtgattttcatggcggtttttccccccatagaatgaccaattaatatcactttggataaatttaagtggcggattactgcgataacatcttcagccatcagttgataattcattttttccgaatgaaaactatggccgtgattgcgtaaatcaatacgtaaaatactgtaatgttcactaaaagctctcgcgataacgccgagattatccatatcgccgaataaaccgtgaataaaaattaaaacaggtgtattaatcgtttgttttacttgatgaaattgataattgagtaatgattttgccataatttttacgtgagaatttgtaaagaagtcgttataattgaaaaaaattttagcaaacagagagataaaaatgaagatcattgaagtagatgaagaattataccaatatattgcgagccaaacccgctctattggagaaagtgcttcggatattttacgccgtttgcttagtttacctgtgcatacttcaattgttaatgatttaattattacttcagcagaaacagatcaaaagccaaaacaggctatcaatgtgaaagaagtaaatatcaaaacaacaaaaaagcaatcaataaccgcaattaatcagattgtagaaaaagtccaaactttattaaattcaactgaatttcaagaagaaagtaaggctgttgtacgtttcttagcgattttacgtgtgctttatcgtacaaatcctgaaagttttgcgcaagcaacggaatctttacaaggacgtactcgagtttactttgcacgcgatgaagcgacattattaatggcaggtaaccatactaaaccaaaacaaattccagatacgccttattgggttattaccaatacaaatagtggacgaaaaatgttaatgctagaaggtgcaatgcaatctatggaattacctgaaacattgattgatgaagtgcgatcatatttcacggtaaattaataatgtatccttggcaagattttgctattcaacctgatttctcagataaaatcgctttgcgtactacgcagggcgatatgcttacttggatagaattgactacaaagattaaccaaacagtggcttttttacaaaaaaaaggcgtaaatgcagaaagtgcggttgcttttgtgggaaaaaattcagagaaaattttatttttatatctggcgacaattcagcttggcgcaaaagttttaggcataaaccctgcttttccacaagaaaaaattgcaaaattatgtgagttttatcaaattgatttttgtttttatgataaagatttactgaatttgcaagaaattgatgtttttactcaaaaagccgatttttttcgtcctgcgacgatgacgctaacgtctggctcgacaggtttaccaaaagcagttgtgcataatgtccaagcacatttggataatgcaaaaggggtatgtaacttaatgaagtttgattgtaatcaatcttggttactttcattacccttatatcacgtttcagggcaaggtattgtttggcgttggttatattgcggtgcacaattacatttcccagaagatgatttttatgcttcattattaaagacgacccacgtttctcttgtgccaacgcaattacagcgtttattagattatttacaggaaaatccgagcatttcatttgctacacgccatattttactgggcggtgcgcatattccgacagaacttacacaaaatatgttgaaatatggtatcgaaacgtattctggctacggaatgacggaaatggcttcgacagtttttgctaaaaaatctgacagaaaacaaggcgtagggcaaccgctcttaggtagagagtattgtttagtaaatgatgaaatttggctgaaaggtgcaggtttggcgatgggttattggaaagatcgacaaattgttccattaacgaataaccaaggctggattcagacaaaagataaaggcatttggcaagagggcgaacttgttattatcggacgacttgataatatgtttatttcaggtggcgaaaatattcagccagaagaaattgaacaagtgattattcaacattcttcagttaatcaagtatttgttttaccacaaaaaaacaaagaatttggtcagcgtcctgtcgctttagtggattttaatgagccctttagcaaaagtgcggttgaaaatttaatgttttttttacaagataaacttgcacgttttaaacaacctattgcatattatcctttgccactgatgcttgagaaaggcattaagatctcacgtaaacagcttgctgattggttggcaaagcgagatgagataaattaatttaccatttagattagggaaaaataatgattaggaaacttatgaaaatacctccattttttaccgcactttttgcctcggcaatgtttacccttagcgtttcgcaaggggtattggcggcaaattcaacaaatgtattaccaacggagcaatcgcttaaagccgatttggctaacgctcaaaaaatgagtgagggggaggcaaaaaataggttgttagcagaattacaaacatcaattgatttattgcagcaaattcaagcccaacaaaaaatcaatgatgcattgcaaacaacattaagccattcagagagtgaaattagaaagaataatgcagaaattcaagcattaaaaaaacaacaagaaacggcaacaagtactgatgataatgcgcaatcacaggactatttacaaaatagtctcactaagttaaatgatcaattacaagatacgcaaaacgcattaagcacagcaaatgcacaattggcagggcaaagttctatttctgaacgagcacaagcggcattaacagaaaatgttgtacgcacacagcaaatcaatcaacaattagccaataatgatattggtagcacattgcgaaaacaatatcagattgatttacaactgattgatttaaagaatagttataatcaaaacttattaaaaaataatgatcagctttctttactctatcaaagccgatataacctattgaatttacgtttgcaagtacagcagcaaaatattattgcgattcaagaagtcattaatcaaaaaaatcttcagcaatcacaaaatcaagtagaacaagctcagcaacagcaaaaaactgtgcaaaatgattacattcaaaaagaacttgatcgcaatgcacagcttggtcagtatttattacaacaaacagaaaaagcgaattcattaactcaagatgagttaagaatgcggaatattttagatagcctcactcaaactcaacgtactattgatgaacaaattagtgcattacaaggcacgttagttctttcacgtattatccagcaacaaaaacaaaaattaccgactaacttaaatattcaaggtttatcaaaacaaattgccgatttgcgtgtacatatttttgacattactcaaaaacgcaatgaactttatgatctagataactatattaataaagttgaaagtgaagatggaaaacaatttactgaggcagaaagaacgcaagttaaaacgctattaactgagcgtcggaaaatgacatctgatctgattaaatctttaaataatcaattaaatctcgcgatttctttggaattaacacagctgcaaattacacaaatcagtgatcaaattcaatctaaattagagcagcaaagtttttgggtgaaaagtaataatcctattaatttagattgggtaaaaatgctgccaagagctttaattgaacagtttaatggtatgttgaaaaaattaggttttccaactaattatgacaatttaccttatttgctgatgtatttcttagggttatttattgtaggcggtgcaatttttaaatttaaaaatcgtattaaacaacaattaaacaaaattaatcgtgaaatacatcgtttagatacagatagtcagtggagtactccacttgccctgttattaacagcgtttttaacgctttctagtacactttggtttttagcagtttgccaaatgatcggcttctttttcttcaaaaatccagaagaattttggcattggtcatttagtatggcgggttattggtggttctttacattttggatttcattgttccgtccaaatggtatttttgttaatcattttgaatcttcaaaagagaatgcacaacgttttcgtggtgttatccagcgcattattgttgtggttgtattgcttttaaatacttctgtgtttagcaatgtcactgatgcaggtttagctaatgatgtgttaggtcaaattaatactattgcggctctaattttctgtgcggcgattattgcccctcgttttaatcgagtacttcgctcttatgaacctgaaacaaataaacatcattggttaataagaattgtacaaattggttttagattaattcctgtgggattaatcgtacttattgttttaggctattactacaccgctttaaatttaattgagcattttattcattcttatattgcttggtgtgtatggtggttagtacgcaatacgatttaccgtggtattacggtttcttctcgtcgtttagcacatcgccgtttagcagaaaaacgtcgtcaaaaagcacttgaaaataattatgaaaatatatcctctgatgatgtggttgcagtgggagagccagaggaaagtttggcgttaaatgatgtgcgtagccaattattacgttttgtagatctctttatttggacagcattattagggatcttctactatgtatggtcagatttagtcaccgtagtgagctatttacgtgaaattacactttggcaacaaaccacgacaaccgatgctggcactgtaatggaaagcattactttatttaatcttcttgttgctttggttatcgtaggaattacttatgtgttggttcgtaatatttcaggcattttggaagtattaattttttctcgcgtgaatctttcacaaggtacgccttatacgattacgacactacttacttatatttttatcgccattggtggtgcgtgggcatttgcaaccttagggatgtcttggtcaaaattacaatggttattcgccgcactttctgttggtcttggttttggtatgcaagagatttttgcaaactttgtgtcaggtatcattttgttatttgaacgcccaatccgagttggcgatgtggttaccattaatgaagtgagcggtactgtagcgaaaattcgtatccgtgcaattacattgattgattttgatcgcaaagaagtgattgtgccaaataaatcttttgtgactggtcaagtgaccaactgggcattatctaacactatgacacgtttagtgattagcgttggtgttgcttatggttctgatttaacactcgtgcgccaattattacttcaagcagctgatgaacaaccgactattttacgcgatcctaaaccatctgcttattttttaacttttggtgcaagtacactggatcacgagttacgtgtttatgtagaacaagttggggatcgcaccagtactacagatgcccttaatcgccgtattaatgaattatttgcagaacataatattgatattgcctttaatcaattagatgtatttatcaaaaataatgatacaggcgaagaaattccttttgttgatgtaaaaaaataagggcaaattatggctggtaatacaattggacaacttttccgtgtgacaacctttggagagtcacatggtattgcattaggctgtatcgttgatggcgtgccaccaaatctcgaattatccgagaaagatattcagccagatttagatcgtcgtaaaccaggaacatctcgatatacgacgcctcgtcgtgaagatgacgaagttcaaattttatctggtgtgtttgaaggaaaaaccacaggcacaagtattgggatgatcattaaaaatggagatcagcgttcgcaagattatggtgacattaaagatcgtttccgcccaggtcatgcggattttacctatcagcaaaagtatggaatccgtgattatcgtggcggtgggcgttcgtcagcacgtgaaacagcgatgcgggttgctgcaggggctattgcgaaaaaatatttacgcgaacattttggcattgaggtgcgaggttttttaagccaaatcggtaatataaaaattgctccgcagaaagtgggacaaattgattgggaaaaggtaaacagtaatccattcttttgtcctgatgaaagtgcggtagaaaaattcgatgaattgatccgtgaacttaaaaaagaaggagattctattggcgcaaaacttactgttattgcagaaaatgtacctgtaggattgggcgagccagtatttgaccgtttagatgccgatcttgctcacgcattaatgggaattaatgcagtaaaaggtgtagaaattggcgatggctttgctgtggttgaacaacgaggttcggaacatcgtgatgaaatgacacctaatggctttgaaagtaatcatgcaggcggtattttaggcggaattagttcaggacaaccaattatcgccactattgcactaaaaccaacttcaagcattacgattcctggtcgttcaatcaatcttaatggtgaagccgtagaagttgtaacaaaaggtcgtcacgatccttgtgtggggattcgtgctgtgccaattgcggaagctatggtggcgattgtcttattagatcatctcttacgttttaaggcacagtgtaaataatcctgtacctagggtagtatactctaggttagttcttcaataggactgaacctaggatatacttacctacagcaaaactttagaatgaataaaattttattaaaaacaaccataatttttaccgcacttttctctctgaacgttgttgcgtctcctctagattggcaaaaagtgaaacgccctattccaagtgaagatggtaaagcaagtcctattggtagttataccaacgggtgtattattggagcacaagcattaccgccgaaaggtgaaggttaccaagtgattcgcatgaatcgcaatcgttattatggtcatccaaatatgattcagtatcttgaacgtttggggcagcgagctaaagctgctgggttgccaacgatgttagtaggcgatattgccatgcccggtggtgggcggtttttaacgggtcatgctagccatcagatgggattagatgcggatatttggttaagaatgggcgaaatgtcagatgccgatgcgctcaattctgatggtaaaggtttattagttgtggatagaaaggcgcaacgagtagatgagcgcgtgtggaatagcaatcatgcgacgttaatcaagttagctgcgcaagatccaaatgtgacgcgtatttttgttaatcctgcgattaaggtaaaattatgtcaaaccgctggcaatgatcgcggttggctacacaaaattcgtccttggcatggacacaactctcattttcatgttcgtttaacttgcccagcagatgcatcttattgtgaaaatcaagcgcctgtgcctgctggtgatggttgtggagacgaattatattcttggtttgaaccgccaaaaccaggcacttcagtgagcaaacctaaagttacaccgcctgagccgtttttgtgccaacagattttgaactcaccgaatcggagagaatggttagaatagcattgaggtaaatcaatatggatatcggcattgatcttttagcaatattgttttgtgttggttttgtcgcatcatttatcgatgcaattgctggcggtggtggattaatcaccattccagcgttactcatgacaggtatgccaccagcaatggcgttaggcaccaacaaattgcaagctatgggcggtgcattatccgcaagcctttatttcttgcgaaaaagagcggtcaatttacgcgatatttggtttattttgatttgggttttcttaggttctgccctaggtacattattaattcaatcaattgacgtggcgattttcaaaaaaatgcttccttttttgattttagccattggtctatatttttaatttactcctaaattaggtgatgaagatcgaaaacaacgattaagttatctgttatttggtcttttagttagcccatttttaggtttttatgatggcttctttgggccagggactggctcaatcatgagtttagcctgtgttactttgctaggatttaatctcccgaaagcggcagcacatgcaaaagtgatgaacttcacttcgaaccttgcttcttttgcacttttcttattgggcggacaaattctttggaaagtgggtttcgtgatgatggctgggagcattttaggtgcaaatttaggtgccaaaatggtgatgacgaaaggtaaaaccttgattcgaccgatggttgttatcatgtcttttatgatgacggctaaaatggtttacgatcagggttggtttcatttttaattcggaaagcgcgcaaaagtgcggttaaaattaattacattttattatgtcggataatcaacaaaatttacgtttgacggcgagagtgggctatgaagcgcacttttcatggtcgtatttaaagcctcaatattgggggatttggcttggtattttctttttattgttgttagcatttgtgccttttcgtctgcgcgataaattgacgggaaaattaggtatttggattgggcataaagcaaagaaacagcgtacgcgtgcacaaactaacttgcaatattgtttccctcattggactgaacaacaacgtgagcaagtgattgataaaatgtttgcggttgtcgctcaggttatgtttggtattggtgagattgccatccgttcaaagaaacatttgcaaaaacgcagcgaatttatcggtcttgaacatatcgaacaggcaaaagctgaaggaaagaatattattcttatggtgccacatggctgggcgattgatgcgtctggcattattttgcacactcaaggcatgccaatgacttctatgtataatccacaccgtaatccattggtggattggctttggacgattacacgccaacgtttcggcggaaaaatgcatgcacgccaaaatggtattaaaccttttttaagtcatgttcgtaaaggcgaaatgggttattacttacccgatgaagattttggggcggaacaaagcgtatttgttgatttctttgggacttataaagcgacattaccagggttaaataaaatggcaaaactttctaaagccgttgttattccaatgtttcctcgttataacgctgaaacgggcaaatatgaaatggaaattcatcctgcaatgaatttaagtgatgatcctgaacaatcagcccgagcaatgaacgaagaaatagaatcttttgttacgccagcgccagagcaatatgtttggattttgcaattattgcgtacaaggaaagatggcgaagatctttatgattaaaaatagggtttgaaagtcatattctcgaaaacggatattcaataaggtaaataagaaatggaagaaaaaattcggctgacgcaatacagccatggtgcaggttgaggctgtaaaatttcgcctaaggtgttagggacaattttacattcagaactggaaaaattttatgawccaaatctgatcgttggcaatgaaactgcagacgatgcggcggtgtatgatcttggtaatggaactgcaattatcagtaccacagactttttcatgccgattgtggatgatccttttgattttggacgaattgctgcgaccaatgccatcagtgatatttttgctatgggcggtaagccgataatgggaattgctattttaggttttccaaccaatgtattacctgcagaagttgcacagaaaattgttgatggtgggcgttttgcttgccatcaagcggggattgctttggcgggtggacattccattgattcgcctgaacctatttttggtttagccgtgacaggcgtgattgacactgaaaaagtgaaacgtaatgcttctgcaaaatcaggttgtaagctttatatgacgaaaccgcttggtattggtattttgacgacggcggaaaaaaaaggaaaactaaaaccagaacatcaaggtttagccactgccgctatgtgccaaatgaattctattggtagtcaattttcccaagtggatggcgtcaccgcaatgacggatgtcactggatttggtttacttggtcatttaattgaaatctgtgaaggttcaaatctaagtgcggtagttttttcggacaaaattaaaaccttggacggtgtaaaagattatattgctcaaggttgcgtaccgggtggaacagggcgtaattttgacagttatggacataaagttgggatattgacggaagaacaaaaagcgattttgtgtgatcctcaaacatcaggcggcttattagtggcagttgagcttaatagcgttcaaacagtaattgacatagccaaagatgcggggattgatttatatgaagtgggtaaattgaaacctaaatcagaatccgatatcgttgttgaagtaaaataaggaattttaatcgatcctccctaatgattaattaaattaccatgatccacatagcaaaaaaccttggaatatcccaaggttttttagattatcattaaatataatgaattatgcgcctaaacgctctttaatacgagctgatttacctgaacgttcacgtaagtagtaaagtttagctttacgtaccgcacctttacgtttaactgcgatagaatctacagctggagagtgagtttggaatacacgctcaacgcctacgccgttagatactttacgtaaagtaaatgctgagtgcaagccacggttacgaattgcaataaccacgccttcgaatgcttgcaaacgacgtttgctaccttcaaccacccatactttaacttctaaagtatcacctgggcggaagctaggtacgttttgttttaattgttcttgttcaagttgtttgataatgttagacattgtttgatcctttattgatcctagatgtaactgaaactaactgttatgctcggcttgcgcctcttttaacagcttacgttgttcgtcagtcagagctaggccttctaagagctcagggcgtcggagccacgttctctgtagcgattgttttaatcgccatttccgaatttcttcgtgatgtcccgacatcagcacgggtggtacagttaatccttctaacacttctggtctagtgtaatgcgggcaatctaataaaccatctgcaaaagaatcttcttctgccgaggcttgtttgcctaatacaccgggaataaaacgtgcaacagcatcaattaatgtcattgccggcaattccccaccggtcagaacgtaatcgccgattgaccattcttcatcaatttcagtttgaatcaaccgttcatcaatcccttcgtaacgtccacatactaaaatcaatttctgattttgagcaagctcggttacgccgccttgatcgagtttacgtccttgtggcgaaaggtaaatcacctttgcgccttctcctgccgcagcttttgcagtatgaatcgcatcccgtaaaggttgcaccatcattagcattcctgggccaccaccataagggcgatcgtccacggttttatgcttgtcgaatgtaaaatctcttggattccaacattcaactttcagaagattatgttttacggctctacctgtaaccccaaattccgtaattgctttaaacatttcggggaataatgaaattacccctatccacataaaaagcctactacattacgtttgtgcatacttgagattagaaaccagcgtcccaatccacttcaatagttttcgtggtgagatcgactcttttaactacttgttcatacaaaaacggaattaaccgctcttgttttccaaaagcatctttggtattggctttaaccactaatacatcattagaacccgtttccatcatttctgttactgttcccattgtataaccttctaagtttacgactgtacaaccgattaaatcgtgccagtaataatcgccctcttctagttctgggaaaacagataaatctacaccaatttcaacattcgctaaaatttgtgcagcttcacggtcatcaacgccttttaatttaacgatgatttcgtgattatgataacgccagttttctaattcaattgattgccattcgcctttgatttttaaaaaccaaggttgataatcaaaaatgctttcagcttgttctgttgatgaataaatacgcaaccacccacgaataccgtaggttgagcctaatttgcccacaacttcaatatgttgttgttccatatttttcacctatcttagtttgagaactaaatcaaaaagcaaaattatgctgctttttgtgcttcttttaccaagctcgcaacacgatcagaaagtgaagcaccttgagcaacccagtgatttacacgctcaagattaatgcgaagacgttctgcattaccttgtgcaattggattgaagaaacctacacgttcaatgaagcgaccgtcacgaggtgaacgactgtcagcgactacgatttgataaaatgggcgttttttagctccgccacgagataaacgaatggttaccataaccttcctctaaatgtttaattactaaaagaatattctcaaattcgaaagtgatttgagaatatagcttacttttttctctgtatatatagacaaaaagcctgcgaattttatacttttcaagcaaaattgcaagttttgtatgcataaagtaggttgtattccttttaattatcattcacaatttattttgttttacgatataatacgaggcatccagctgttttaggtcaaatttacgcgtatagcggtattttagcttgataaaatatcagttaaatgaggtttatatatgaaaattagttttcattctgtgttaattggattagcatcatttattggtgttcaacaaggtgtaatagctaatccgtcttctcatcaatcaatatccactgaatcagctgaggctttgaagcaacaattttcaatggctttagctaaacaagataaacaacaaattacaaatttacaaaaaaaacttaccgcacttttttctttacctccccaatttcttgataatcagatccaaataagcgaaaaaancctcactcgcatttttaaaacagataaaaatctcacgcctaaatttcttgattacttatactttgagccaataaatactgttgatgctaatttaattcaggaaatgaagaaaaacttactggtgtcttttttagcaaatgatcaggcaaaaatttatattcgtcaaacagataattcagagcaatttgttcagactttaatggagcggggagcaaaagcagatcaaattatattactgtctttgaatgccaaaggtatatttcaaaaaattattgaacaaatacgtcaagattttccgaatcagactattttttcgattactgaaaatcgtattagtttgattactccttcttcagaaattaagtctcgccttgctttagcaaatatgatgttcaatcgccaatttaaaggtgtggaagttgatgatttctcatatttagatcaacctcgagaaaatttacagcacaataatgatgcaattcgttacaaaacctttcaagcaatgctagaaggtttaaattaatcccttaccaataggagtttttatgcttttatccaaaaaatcagcctcctttgcactcagtgcatttgcgatgcttttcactagtgtagctcttgccaaagaggcaccacaagctcacaaagctgtggaattaagtattttgcatatcaatgatcaccattcttatttagaaccgcacgaaacacggattaatttaaatggtcagcaaaccaaagtggatattggtggtttttctgctgtcaatgcaaaacttaacaaattgcgtaaaaaatacaaaaatccattagtactgcatgcaggcgatgccattactggtacactttacttcacgctgtttggtggttctgcagatgcagctgtgatgaatgcaggtaatttccattattttactttaggtaatcatgaatttgacgcgggtaatgaagggttattaaaactgcttgaaccattaaaaatcccagtgctttcagctaatgtgattcctgataaaaattcaattttgtataacaaatggaaaccttacgatattttcactgtggatggagaaaaaattgccattatcggtttagatactgtgaataaaacagtgaattcctcttctccgggtaaggatgtgaagttctacgatgaaattgctactgcacaaattatggcaaatgcgctaaaacagcaaggaattaataaaattatcctactttcacacgcaggtagtgaaaaaaatatcgaaattgctcaaaaagtaaatgatattgatgtgatcgttactggcgattcacattatttatacggaaatgatgaattacgtagtttaaaacttccagtaatctatgaatatccacttgaatttaaaaatccaaatggagaccctgtatttgtaatggaaggctgggcttattctgccgtggtgggggatttgggtgttaaattcagtcctgaaggtatagcgtctattactcgtaaaattcctcatgtgttaatgagttctcataaacttcaagtgaaaaatgcggaaggtaaatggacggaattaactggcgatgaacgtaaaaaagcacttgatactttaaaatcaatgaagagtatttcacttgatgatcatgatgcaaaaacagacatgcttatttcaaaatataaaagtgaaaaagatcgtttagcacaagaaattgttggtgtcatcacaggttctgcaatgccgggtggttcagcaaaccgtatcccaaataaagcaggctcaaatccagaaggttctattgcaacgcgttttattgcagaaacaatgtataacgaactcaaaacagtggatttaactattcaaaatgctggcggtgtacgcgcagatattttaccgggtaatgtaacctttaacgatgcttatactttcttacctttcgggaatacgttatatacctataaaatggaaggttcattagtgaaacaagtgcttgaagatgcaatgcaatttgctttggttgatggctctacaggcgcattcccttatggtgcaggtattcgttatgaagcgaatgaaacaccaaatgcggaaggtaagcgtttagtgagtgttgaagtcttgaataaacaaacccaacaatgggaaccgattgatgataacaaacgttatcttgtcggaacaaatgcttatgttgcaggcggtaaagacggttataaaacctttggtaaattatttaacgatccaaaatatgaaggcgttgatacctacttacctgatgcagaaagtttcataaaatttatgaaaaaacatccgcactttgaggcttacacttcatcaaatgtgaaatttaatgcttcaactgatgcattacctaaaaaataaaattgaaaaataggctaaaaatagcgcgtatttaacgcgctatttttgttattagtcctaggtttgaagacttcatagatgattaagaattttaactattccatatttagatgctttctcgtggaaaataaattccctatagaggttgaaaaatagggtgatttattgcgataatctaccccattttttgggagatctttctatcttctgcatttttacgcagtttattttcattagaaatgatcgaattttatttcacttttaatttaattagataaagaacaatggcggaaaaacgtaatatttttttagtaggaccaatgggtgcaggtaaaagtactatcggtcgtcaattagcacaacagcttaatatggattttattgattccgatgcagtgattgaagaacgtacgggcgcggatattagctggatttttgatttggaaggcgaagacggcttccgaaaacgtgaagaacgcattattaacgaactcacacaaatgcaaggtattgtactttcaactggtgggggagcagtgctttctaaggaaaaccgtaattatttatcagcacgtggtattgtgatttatttagaaacaacggtggaaaaacaattccaacgcactcaacgtgataaaaaacgtccattgctccaagatgcagagaatcctcgtcaagtattggaagatttagcaaaaattcgcaatccgctttatgaagaaattgcggacatcactttgccaaccgatgaacaaaatgccaaaataatggtaaatcaaattgttgatttaattgataatatgaatgggttgaatggtgcactttaaacacacctaaggataaattatgctgtgcgtcaacgtggaattgcaagagcgtcgctatcctattttaattggtagcggattgttacaagatgaacgtagttacccgattaaacgtggagatcgcgtgatgattgtaacgaatcccacggttgcacagttttatcttgatacagtcatctatgcgttggaaaaacgtggttgcgtagtcgatcatgttttattgccagatggcgaaaaatacaaaacacttgaatctttaaacttaattttcaccgcacttttgcaaggtaatcatgggcgagataccacgattattgcattgggcggtggcgtaattggcgatgttgctggctttgctgcggcaagttatcagcgcggcgtgcgtttaattcaaattccaacaacattgctttcacaagtggattcttcagtgggcggtaaaacggcggttaatcatgaattaggcaaaaatatgattggcgcgttctatcagccatcaatggttattattgatacgctcacgcttaatacacttcctaaacgtgaagtaaacgcggggcttgccgaagttatcaaatatggtgccattttagattacgaattttttgaatggctagagcaacatattgatgaacttgtcgctttgcatcctgaggcgcttcaacattgtatttctcgttgttgccaaattaaagcagatgttgtcgcgagagatgaaacagaaaaaggcgatcgtgcattgcttaatcttggacatacttttggacatgccattgaaactcacttaggttatggaaactggcttcatggtgaagctgtttctacgggaatgatgatggcagcggcgctttcggaagaacttggagatatttctattgcagatgtgtctcgccttgaaaaattacttgctcgtgccaatttgcccaccgtatctccagatacgatgcagccggaggactatttaccgcatatgatgcgtgataaaaaagttctatcgggtaaattgcgtctggtattactcaaatctctaggtcaagcttatgtggcgaatgataccgaacataccctcgtgttaaacgcaattcgtcgttgtactcaaacggattaagatgttacgtccgaaaaaacaatctttaaaacctaagttaaaacaccgtccatttttaaaatgggcggggggaaaatttcgtttaacggacgagataaataaagcctttccaaacaaaaaaaactgcttaattgagccatttgtgggcgctggagcagtatttcttaattctaattttgaacgctatattttggcagatatcaatcctgatttaatcaatctattcaatattgtgaaagnaaatgtagatggttatattgaagattgtaagccgattttcttcgctgatgatgccaatacacccgattattactatgctaaacgtcgccaattcaatgcatcaacagaacctttcgaacgttcgattatttttttgtatttgaatcgttttggttttaatggattatgccgttataacagcaagaatgaatttaatgtaccttttggtgcttacaaaactcattattttccagaggatgaattacgttattttgcgcataaagcgcaaagtgcggtgtttttatgctgtgattttcaaaaaacttttgaatttgccgataaggattcggtgatttattgtgatccaccttatgctccgctacaacaagagactaattttactggttatgcgggcaatgagtttggactggcgcagcaacgtgctttggcagatttagcgaaatctatacaaaaagaaaaacaaatttcgatattgatctcgaatcacgatactaaatttacgcgtgaaatttataacggtgctaaatttaaacgggtaaaagtccaacgttctattagccaaaacccagaaaaacgcgtaaaagtgaaagaattgattgcgatatttggtgctcgtaaataataaaaataacccttactttatactaaaagtaccaaaatcgtaattttaaaaccacaataaaataatatattatgtattaccatttatctcttacagtacctatatacttttttgatactaactcaaaatactcacaagtctgtaattttacctgtaatccttttgttttatcagaatgattatctagaaaactcatccaatcatcagaataattaacaaataattattatcctatagtagaatgtaaattattttaataacgccttatttgtactgtggataattcatcaaaatttaagcctgttatgctttattctttagtgtataacaaataggataaaaatggaaaaagcaaaaccatccaagcaaagaaattttaatcactgtcaaggagtacattattgaatttggtaataaaccgttaggtttaaaagatactacacccaaatgccactgccctatttgtgctcaagttttatttgagaaaaatgttaatacagtgccatcctctaatagcaatttttctaattacccaaaaagcgaattctgccccataaaattaaactaaagcaatttataccaatcatattttccattatcaccaaataaaacgcatggactgaattaaaaaatttattcagaaaaaattggcaaaaatattatcgtcaaattagttttttggcaaaaaacttataacctattgaatttattatattagctaatcaacaaaaaatttgggaatacgataaacttgaagagtatcaaattccttatattctattaacattagcagactgtcctaaccaaaaaggaacatataaaaataaacgtcactgctggtttagattttggtttgatgcttcaattcaaagatatgaagatatttggaataatagttctttaccagtattgtggacaacctattattacctatcagggaaacaaagaaaaccttcagaaataaatctaaaaaacatgaattatttcatcatggataaaactttcttagaacaagaaatattacttccccaatttattattcaaaatatagaacggtggtttaaaacacacaattttgtatagacaagtcagcacctaatactatttcatgacgaagatcgcctttttctttaaaaaggcaaaaataatgctattaatcaaccatgccagtaatgtcgccaccaacaaatctattgggtaatgcatgcctaatcgcacacggctaatcaacatcaataagccccacactgcaatacccaccaccagcaattttgctttaaaagaacggttacccaataattgggtaaagccaacagcaagcattagccaagttgctgcaaaaatcgtatgtccagaagggaacgaataccccgtttcattttcataatgatgaactaaccaagctggtgtaatggcatccatcgaataaaaattcttagctatttcagcacgcaaagtgcggtcatttttataaaagttttcaggcgttgaatgagtttgctcagctagataaacggtgaatggacgaggttcttcaaataatgcttttgcccctgtttttgcggcttgagttgcaataactgaaatccccatcacaattacgcctaatatccattgttttggatttttaaataaaaacgcaaacaaaagcgtaaacaacacacaggtgatcaacgcataaggtacgctacccgtttcagtgagcaaataaagccaataatcagcttgagttaattggctattaccatgccactgataggaaataccccaaataaaaaatggtacaagacaaagtaataacgtatataatgacagccttttgaacatgctcgccccttgataacaaaaataacgcgcgcattctaacagaaatgactacgaataaggatcactttatggcaaaaattcagctagttgcgcaagccaatttacccactgaatacggtattttcaaaatggtgggatttgaattcccagatacaaaaaaagaacatgtagccttagtgatgggcgatatttctaatgctgatgaacctgtattagcacgtatccattctgaatgtttaactggcgatgcgcttcacagcttaaaatgcgattgtgggttccaactggcgacagcattaaaacaaattcaagaagaaggtcgcggagtcttaatttatcatcgtgaagaaggtcgcggaattggtttgattaataaaatccgtgcttattctttacaagataaaggaatggataccattgaagctaatcttgctttaggtttcaaagcggatgaacgcaactttgaagtctgtgccgatatgtttgagctacttggtgtaaaaaaagttcgcttaatgaccaacaacccagaaaaagtagaaaccatgaaaaaagcaggtatcaacgtggttgaacgagtaccgcttaatgtaggcgaaaaccgctacaacacaaaatatcttgatacaaaagcgaaaaaaatggggcattacattgtgcataacaatgacgaacaacatttaatgacctgtccacattgccaggaagagattatttaacaaataagatatgtttaaaaagccatactgttatattgaacagtatggcttttttatttaaactttatgttatggaataatcaaaagattttttagcatattgctaaaaacgggaaaccccgtctcgtattccaaagatcggggcttatcaggagtaagtaaaatgaaaaaaattgcctttttcattttcttgattatctgttgtttagttagctgttccggaacagttatctaagataatcgcaaggggacgatgtaggagttgtccccaatgcctccaccaatcttaaagaattctttccttgattgcaagggcaattattgactttgaacctttctccacaaatctttactgtaaatgacaccgacagaatttacttgcgcacccattatactcggtacaagataaacaggcgtactatattgaaaaataggtaacactaaatgctcttgttgaactatcccttttaatttcgcgtaattttctaaccgcactttttcggatatcgtcgtcattgcactttcaaataaacgatcaaattccgcatttttatagccatttttgttatctgggctttttgaatagaataaatttagaaatgctgcaggatcattaaaatcagcacaccagccagaacgaattaattgaaaatcgccttttgtgcgggcggtttgcaattcttgccagctcatcccttgattttcaactcgtaataaatcagattgtgataattgatgatttaatcgcattgcaatggtttgattcagagataaatcatcataacgaatacgtaatttcaatggacgagtttcactaatttgattttgggaaaagagctgttctgcaacaactggctcccaaacagattcttgctcacctagcatagattttggcaaaaaagtattgttaggataaagatgagcaatatctgcaaccaaattattggtagaaatcatcgaaacaatcgcttttcttaccgcacttttttgtaacacaggatcggaaagattaaactcatagaagtaagtacaaagttgcggataatcttggatattctgattgacttttttcggattcattacaacatcaaaatcagacaaatctgcatcaacggaaattttttgatacttcacttgctgaaatatcactttttctttcgcccaataataaggattggtagttaaaatgtgctgattttcagcctgcctttgtaattgatatgcaccattgctgataaatatttcagtcgatttagcatagtgaggcaaaagactgacatgtgccagcatagaaggtaaatatggcgatgctttatctaattcaatgcgtaaagtgcggtcattttcggcaaacaatcctagggattcaacaggtaacgctttttccaatactgccttcgcatttttcagattcataaaagccaaataatttttaagtgggctttcagattgagaaagtgtttgccaagattgtacaaaatctgatgcagtgataggctcgccatttgaccatttagcattttcacgcaaagtgaaaatccaagttttattgtcttcggtttgccaattttctgctacagctggaacaagattaccctgcacatcataagctgttaatccttcaaaaagatctcgtaataattgagtttgttcttcgctttgtgcttgccaaggttgcaaagtcaaatcgctataaacgccacgttttaattcaactcggttagattccaattgagtatttttttgtgtctcaatttgtggcgaaataggcttaggactatccaatttatcacaagccaccaccgtaaaaataatagaaaaaataaccgcacttcgttggcacaaagcgaacaaattattcattttcggttttaatccaaaataagaagaaccaaaacttaatacaaatcaacgcaacaataacactacgccctattacacttggcgtgaaataaaaaccaattagtagcattgtggtaacaaaagtcaaaataaaaattttggtatttttctttaatgatcgattttcatgaaaggacttgagatgtttttgataaatacttgtgcctaaaaaccattgttctaagcgttttgaaccttttgtgaagaaaaataaagtaagtaataaaaaaggcgtggtaggcaaaagaggaaggaaaaatcccaatgatgccaattgcaagtgaaagaaaacctaaaataatgtaaataattttcataatgttcctaataaaaaaggaaaatgcaaactattattactgattttttagatttttcaaccttgatattatagaatttgccgtcacataaaaaaacagttttcaaaaaaggaacatttatgtctatgtcaaatccattacttaacattcaaggcctaccgccattttcacaaatcaagccagaacacattcgaccagctgttgaaaaattaattcaagattgtcgcaatacgatagaacaagtgttaaaacaaccgcactttacttgggaaaatttcattttgcctttaacggaaactaatgatcgcttaaatcgtgcttggtcgcccgtttctcatctcaattcagtaaaaaatagcactgaattacgtgaagcctatcaaacgtgcttgccgttactttctgaatacagcacttgggttggtcagcataaggggctttataatgcctatttagcgttaaaaaatagtgctgaatttgccgattattcgattgcacaaaagaaagccattgaaaattcactgcgtgattttgaactttcaggcattgggctttccgaagagaaacaacaacgttatggcgaaattgtggcacgcttatcggaattaaattcacaatttagcaataacgtattagatgccaccatgggttgggaaaaactcattgaaaacgaagcagaacttgctggtttacctgaatccgcactacaagctgcacaacaatctgccgaaagtaaaggattaaagggctatcgttttacgttagaaatcccaagttatttgcctgtgatgacttactgcgaaaatcgtgcattgcgtgaagaaatgtaccgtgcttatgcaacacgtgcctctgaacaaggccctaacgctggcaaatgggacaacagtaaagttatggaagaaattctgacgttacgcgttgaactggcaaaattactcggttttaatacttataccgaactttcacttgccacaaaaatggcagaaaacccacaacaagtgcttgatttcttagatcatcttgccgaacgtgccaaaccacaaggcgaaaaagaactgcaagaattgaaaggttactgcgaaaaagaatttggtgtcactgaacttgcaccttgggatattggtttttacagcgaaaaacaaaaacaacatttatacgccattaatgatgaagaacttcgcccatattttccagaaaatcgcgtgatttcaggattgtttgaattaattaaacgcatttttaatattcgtgcagtggaacgcaaaggtgtggatacttggcataaagatgtacgtttctttgatttaatcgatgaaaatgatcaactccgtggcagtttctatcttgatttatatgcacgcgaacacaaacgtggtggtgcgtggatggatgactgtatcggacgtaagcgtaaactggatggcagcattgaaacgcctgtggcttatttaacctgtaacttcaacgcaccgatagggaataaaccagcgttatttactcacaatgaagtcaccacgctattccacgaatttgggcacggaatccatcatatgctcacgcaaattgatgtatccgatgtggcgggaataaatggcgtgccttgggatgctgtggaattaccaagtcaatttatggaaaactggtgctgggaagaagaggctttggcgtttatttcaggacattacgaaacaggcgagccgttgccaaaagaaaaactcacgcaattgttaaaagcgaaaaatttccaagctgcgatgtttatcttacgtcagcttgaatttggtatttttgatttccgtttacatcacacctttgatgcggaaaaaaccaatcaaattttggatacacttaaatcagtgaaatcacaagttgccgtcataaaaggcgtagattgggcaagagcgccacacagcttcagccatatttttgcagggggctacgccgcaggttattacagctatttatgggctgaagtattatcggctgatgcttattcacgctttgaagaagaaggtattttcaacccaatcaccggcaaatcattcttagatgaaattctcacccgtggcggctcagaagaaccaatggaactcttcaaacgcttccgtggccgtgaaccgcaattagatgcgttgttaagacataaaggaattatgaactaatacgtcaaactatagggcatgcacaacatgccctttctcaaatattttcctcgacataaaaacatagtaaattttaaccgcactttatctagacaaaacctgcaaacgagacattatttttacaaatagctgtaagataaacgcatagaaattcacgcagaataaactaatttcctgtataatttttcacatatctatccaactcattacacaaaatattctgaggattttatggctgctgcaattcaacaacgtgccgaacttcaacgccgtatttggcaaattgctaatgatgtgcgaggctcggtcgatggctgggatttcaaacaatatgtgcttggcacacttttttaccgttttattagcgaaaattttgccaattacattgaagcgggcgatgaaagcgtaaattatgcccaattacctgatgaaatcattacacagatgccattaaaacgaaaggctactttatttacccaagccaattatttaagaatgttgcggctaatgctggcagcaatcctaatttgaatactgatttaaaacagatttttactgatattgaaaactcagcgacgggctttccgtctgaacaagatattaaagggttatttgccgattttgataccaccagcaatcgcttaggcaataccgtaaaagataaaaacgaccgcttaacggctgttttgaaaggcgtggctgaacttgattttggcaaatttgaagataaccacattgatttatttggcgatgcatacgaatatcttatttctaactatgccgccaatgcaggcaaatctggtggcgaattttttaccccacaaagtgtttccaaactcattgctcaaattgcaatgcacgggcaaacctcggtcaataaaatttatgaccctgcagcaggttctggctcacttttgcttcaagccaaaaaacaatttgatgaacatattattgaagaaggctttttcgggcaggaaattaaccataccacatacaaccttgcccgtatgaatatgtttttgcataacatcaactacgacaagtttgatattgctttaggcaacaccttaatggaaccacaatttggcgataataaacctttcgatgccattgtttcgaacccgccttactccgtgaaatgggctggctccgacgatccaacattgattaatgatgaacgatttgccccccgcaggcgtgcttgcaccaaaatccaaagcggactttgcctttattttacatgcgttaagttatctttcagcaaaaggccgcgcggcgattgtttccttccctggtattttttatcgtggcggtgccgagcaaaaaattcgtcaatatttggtggataataactatgtggacgcggtgattgcgcttgcgccaaatctcttttttggcaccagtattgcggtgaatattttggtgctttccaaacacaaacccaatttatcgatgccagcggtttatttaaatctgccactaataaccacattttagaagaggaacatatcgagcaaatcctcaaactgtttgccgataaagaggatgtgccgcatttggcaaaatccatatcctttgaagaaatcgcccaaaatgactacaaccttgcagtaagttcgtatgtggaacaaaaagacactcgtgaagtgattaatattgatgaactcaatgctcaaattcgtgaaactgttaccaatattgaccacttgcgtgcggaaattgacaagattgttgcagaaattgaagggtaaaatgtagggtgggcttcagcccanatttacgataacaggtagtgggctaaagcccaccctacgaggaacaataaaaaaacaccatgaaaaacaaccgcacttttttagaaaaattattggaggggtctgaggttgagtggaagcctttagatgaagttgccaatatcgtcaataatgcaagaaaaccagtcaaatcatccttacgagtgtcagggaatattccatattatggtgctaataatatccaagattatgtcgaaggatatactcacgagggcgaatttgtattaattgctgaagatggttctgctagtctagaaaattactctattcaatgggctgtaggtaaattttgggcaaataaccacgtccatgtagtaaatggcaaagaaaaattaaataatcgttttttataccattatttaactaatatgaatttcattccattcttagctggaaaggaacgtgcaaaattaacaaaagctaaactgcaacaaattccaatccccatccccccactctccgtccaaaccgaaatcgtaaaaattttggacgcattgacagcacttaccagcgagcttaccagcgagcttaccagcgagcttaccagcgagcttatactacgccagaaacagtatgaatactatcgagaaaaattgttaaatattgatgaaatgaacaaggttattgaacttggtgatgtagggcctgttcgtatgtgtaaacgaattcttaaaaaccaaacagcaagctctggagatattccattttataagattggaacttttgggaaaaagcctgatgcctatatttcaaatgagcttttccaagaatataaacaaaaatatagctatcctaaaaaaggagatattcttatatctgctagcggaactattggtagaacagttatatttgatggagaaaattcttattttcaagatagcaatatcgtctggattgataatgatgaaactctcgttcttaataaatatttatatcatttctataagattgctaaatggggaattgcagaaggaggcaccattcaacgtttatataacgacaatttgaaaaaagtaaaaatttctattcctccattaaaggaacaacaccgcatcgtttcaatcctagataaatttgaaaccttaaccaattccatcactgaaggcttacctttagcgattgaacaaagccaaaagcggtatgaatattaccgagaattgctattaaatttctcgtaacccgtagtgggcttcagcccaccaattaaccataacaaacggtgggttaaagctcaccctacaatgtaatgagaatatttttatggtgggctaaagcccaccctacgaactacaatttggaataatatatgtctaattatcggcgcgattttactaaaggtggattatattttttcacaattgttttacaagatagaacaaaatcttatctaactgactatatcaatgaatttagatctgcatataaacaaacttgtgaacattatccattcgaaacagtagcaatttgtattttgcccgatcatattcatttactgatgcaattacctgaaaatgatgataattacgcaatacgcatcgcatatttaaaaacacaatttacacgacaacttccaaaagaatgccgacaatttaataaaaatagacaaaaatatcgagaatcaggtatttggcaacgccgattttgggagcatttaattcgtgatgataaagatttagcgaatcatttagattatatttattacaatcctgtgaaacacggctatgttgaggtagtaaaagattggccgtattcttccttccatcgtgatgtgaaagcagagatttatcctgaagattggggaggcaacccagatttgaaaattaaaggtgatatataacaatactgtagggtgggcttcagcccacaattaaccataacaaacggtgggctaaagcccaccctacaatgtaatgagaatatttttatgatgggctaaagcccaccctacgaactgaataactgaaaaatatactaaggaaaaaccatgacccaatacaaaactatcgctgaatccaataattttatcgttttagatcaatataataaatttgtggaagaatctaatgctggttatcaaacggaaaggagccttgagcgtgagtttattcgtgatttacaggctcaaggctatgagtatttacaatggcttaataatcacgatgaactgattaaaaacttacgggcgcaattacaacgcttaaataacgtggttttctccgatgcagaatggcaacgttttttagaggaatatttggataaaccgagcgataatctgattgagaaaacccgcaaaattcacgatgattatatttatgattttgtgttcgataacggacgcattcagaacatctatttgcttgataagaaaaatcttgccaataattctctgcaagtcatcaatcaatttaagcaaactggcagctatgataatcgttatgatgtgacaattttggtgaatggtttacccctttattgaattaaaaaaacgcggcgtggcgattcgtgaagcctttaaccaaattcaccgttacagcaaagaaagtttcaataaagaaaattctctctttaaatatattcagatttttgtcatttctaatggcacggatactcgctattttgctaatacgactaaacgcaataagaatagctacgacttcacaatgaattgggcaacggcaaaaaatactctgattaaagatttaaaggattttaccgcgactttcttgcaaaagaatactttgctcaatgtgttggtaaattactgcgtgtttgatgtgagtgatacgttgttaattatgcgtccgtatcaaattgccgcaacagaacgtattttatggaaaattcaaatttcttacttagcaaaaaattggagtaatcgtgaaagtggtggctatatttggcataccacaggttcaggcaaaaccctcaccagttttaaagcctctcgccttgcgactgaacttgattttattgataaagtcttttttgtggtcgatcgtaaagacttagactaccaaacgatgaaagaatatcagcgtttttcgcctgatagcgtgaatgggtcggaaagtaccgctgggcttaaacgcaatattgaaaaagatgataacaaaattatcgtaaccaccattcaaaaattgaataatttaatgaaaagtgaagaaaacctgtctatttatcaaaaacaggtggtctttattttcgatgaagcacatcgctctcaatttggcgaagcacaaaaaaatctaaaacgtaaattcaaaaaattctatcaatttggttttactggcacgcctattttccctgaaaacgcattaggtgcggaaacgacagcaagtgtgttcggtgcggaattgcattcttatgtgattaccgatgctattcgtgatgacaaagtactgaaattcaaagtcgattacaacgatgtccgcccacaatttaaagccttagaaacagaaaaagatcctgaaaaattgaccgcacttgagcagaaacaagcctttttacaccctgagcgtattaaagaaatctcgcaatatttgcttaacaattttaaacagaaaacccaccgcttgaatgccacaggtaaaggctttaatgcaatgtttgcggtaagcagtgtagaagcagcaaaacgttattacgaaaccttacaaaatttacaggcagagcaggaatatccgttaaaaattgcaacaatcttttcgtttgccgccaatgaagaacaagatgcgattggcgatattccagatgagacctttgaacccactgctctaaacagtacggcaaaagaatttttaacaaaagccattgatgattacaatcactactttggcacgaattatggcgtagatagtcaatcattccaaaattactatcgcgatcttgccaaacgtgtgaaaaatcaggaagtggatttactgattgtggtcggaatgttcttaacaggctttgatgcccctacgttgaatactcttttcgtggacaaaaacttgcgttatcacggattaatgcaggctttttctcgcaccaaccgcatttatgacacaactaaaacctttgggaatatcgtcactttccgcgatttggaacaaaataccattgatgcaatcacgctatttggcgataaaaatacgaagaatgtcgtactagaaaaaagctacgacagctattttaacggtgatgacaatcaacgtggctatgcagaaatcgtgaaagaattaaaagaaagctttcctgatccaacagaaatcgaaacagagcaagataaaaaagagtttgtaaaattatttggcgaatatttgcgtgtcgaaaatattttgcaaaattacgatgagtttgcagcattgcaagccttacaagcggtcgatttaaatgatccgattgcaatggaaaaattcaagcaagtacattatgtgaatgatgaacaaattgcagaaatgctgaaagtacccactttaccagtaagagcggagcaagattatcgttcaacttataatgatattcgcgattggttacgccaaagaaaagaggggaatgataaggataattcgccgataaattgggatgatgtcgtgtttgaagtggatttattaaaatctcaagaaatcaatttggattatattcttgcgttaattttcgaacatcataagaaaaaccaagacaaagaggtgttaattgatgaaatccgccgcacagttcgttcaagtttgggtaaccgtgcgaaagagagcttgattgtcgattttatcaaccaaacaaatttagatgatattcccgataaagcgactttaattgactcattcttcctatttgctcaagcagaacagcgaaaagaagcagaatccttaattcaagaagaaaatttgaatgtcgatgcagcaaaacgctatatcagcacttcattaaaacgggaatatgccagtgaaaacggcacggcacttaatgaagtattgccaaaaatgagtctacttaagccacaatatctcactaaaaagcagaagattttccaaaaaattgctgcatttgtagagaaatttaaaggggttggaggaaagatttaaatttaatatatcaacaattagacatcttattaagacataaaggcattatgaattatgaattaataatacaaaacatactggtcaatatttaactagtcgtgataataaaaacagctccaatttatacttggagctgttttttatatcgataaacttactttttacgtgctaaaattcgatttgcacactctgctgcagctgttaagccacctgccatcataataatatctttaatcactaaacgaccaactccagataaataagggaaaccataggctggcgttggtaaatctccacctagattaggcacccaagcctcgggcgttgtgattaaaaatgacagcgtgactattgacatgccaaatgtcagtaggcctcctgccaaacctgccgttgcattccaaataccagctaaagtaagaataccaacagtaacaataattgctccaataatgtaagaagccgtataggtgccattttctttatgccattcgatgttttttgcaaccatttttccttcaggatttttgtgtagtgtatattccatcactaactctcctttatcattcggcactaaatttggccctttttcatacatatagctaaaaaacgggctatttgatacaaagtgagcaattccatctgcctcatattgacaaactttcaaaccaccgatccatgccattacaataaaaatagcaatacggataaaattaataaattgacgctgcattggtgcaacaattctcgcgacaaattcaacaaatgtattaaatactgacatataaatttccacataaaagtaaataaaattgagagcctaattctactcgctttaatattaaaaagcaaaatcaattccctttaataaaagataaataacggagaaatttgaaaagttttactaattaaaataaaatttgattttcccattttaagcctctttattatctttaaatcacatgtaaataatctttacacaactaccttataatattaaaatttacaaaatttaagcaaatcctccacatcttctaaccaaagatttccaattttatcaatcaattctccacaattaaaaacatcagaatttttagccgcactttctaaagtatccgctaattgacgtaaatgatttaaccctaccgatgccgctgcgcctttaattttatgggcggtatcttctgtttctttcatattatcttttgataattgagccagataatttggcatagtttgtttgaataaagataaattttctaaaatttgggattttccaagtgtttctatcagcgctaaatcaaactgttctgaaagctcattatcatcattcatttctataatagattcgctttcatccgcaaaaaattgctgtagacaatggtgtaaatccttaattgaaatgggtttacgtaatacgccatccatgcccatttctaaatattcttgctcgctttgcataacattggcggtaaaagcaatcattggcggtaaaaaatcataaataccgttttcatagttctctcgcaaatattgggcaatttcaaaaccactcatatctggtaatttaatatcgagcaatagaatgtcataaacatttttctcaaataaagtaatcgcctgcttgccatttgtcgcaacatcaacatgatgcccaagtttttctaaaatagtttttgcaaccataatattgagatcaacatcttccactaaaagagtattcaaggatggtatattttncttaacagattctttttcagaaatttcctgagcgtggagagtnagatggaaagtcgcgccttttcctcgttcactttcaactgttaaatccccttcccattaactgagcaagatttttagaaatagccaacccaataccgctacccgcactttgctggcggctttctttcacttgataatacatttcaaaaatatgtttttgttcttcaggtgaaatccccattcctgtatctttcacaataaaatggtaacaatcctgatttctcataattttaagaataatatttccctgatccgtaaacttcaccgcattactaattaagttccacaaaatttggctcaagcgaacacgatcaagattcaaccaattaggcaaattaggttcaagctctaaagaaaaaataagatttttttctttggcgaggaaactagcaaaattataaatatcgtttaataaggcagggaaatctgttggctggcgatttaattcaattcggctggcatcaattttttccaaatcaataatatcgctaaaaatatagcctaaactgaccgcacttatgttgatagtttttaaataattacgctggagatcatccaattcatcatcaagtaaaatctggctaagcccgacaatcccattcaatggcgtgcgaaattcatggcttattgtggcaagtaaggtacttttatcacggctatttttttctaacttttccaatgcttgggataattttttctgagcagcaattcgctcggcgacctcattttccaatcgattaaccgagctagaaagatcaagacgagaatgttcaagtttttctactaataaagtgaaaaaataaataacaaaaggcgcagtgagtaagccaaaagttaccgaacgaaaaatatctacccaagatatctgatgaacaataaatagactaaataaaatctgagtacaaagagctaaaaccgcgagaatcatcacgcctaaaagagaaaaacgaagacgcccaagacgaataacccaatccacataactctgagcaaaatatttgaaatttttcatcaaatctcctaaaacattattatcgttataaaaaaaacctgtgcatataggctttattatatccataaagtaaacgagattgttattactatgtatgcgtaagaaatgaaaaacttaatctttattaattatctgtttgactaaaatttgtaattcaggaataacttgctcttcaaaccaaggattctttgttacccaaagctgattacgtggggaagggtgcacgagaggcataaagtgcggtaagaattgacgataatttttaacagtgttagttacattatctttattttcgggtaaataatatttctgtgcatattgcccaataagaatagtgagctgaatattaggtagattccctaaaatcattggatgccatctttctgcaaaaccttgacgaggtggtaaatcacccgatttaccttttccaggataatagaaatccattggaagaaccgcaaatatcccagaattataaaaataatcgtaatctactcccaaccattctcgcagacgatcaccgcttttatcattccaatacaaacgagattgctcagcttttaacccaggagcttgaccaacaatattaattcgagctgttttaggagccgaaaataaagggaaaattccacgttctgtaaaatctttattttgaggatcagcgataatacttgaagttatttcgtctaaatttttaagcataatgaaggagattagaaatgaatatataaagtctatttgaaaaatatgaaaaatcaaaactctaaatgatgtaaataggtatatttattaaaactatattgtaggcaatacaaaactaaaaacttgatattgaaatacaatctctattttctactttaatccttttcatgaaataatgaataaattcccaaaagctaaaaccccatatctttcgacacggggcccttctgtttttatttaacttagataagtatttggtaacctggcggtgccctactctcacatggggaaaccccacactaccatcggcattacagcgtttcacttctgagttcggtatggtctcaggtgggtccaccgcactatcgccgccaggataattctttgataactcgtcttttctcttttatctctcgtctcttttatctctcgttactcagtctttcctctacctttcactcgttcttattggtcacaagctgaatccgattttctttctattaagtcttctatatttacttttctttgtttagtcttttacttctctttcgctctgcttttatttgcttcgcttttcatctcttacttcacttagctcccaaaaacacttgagcgttgtatagttaagcctctcgggcaattagtattggttagctcaatgactcacatcacttacacacccaacctatctacgtcgtagtctacaacaacccttactgacttaaagtcagggatgactcatctcttggcaagtttcgtgcttagatgctttcagcacttatctcttccgcatttagctacccggcaatgcgtctggcgacacaaccggaacaccagtgatgcgtccactccggtcctctcgtactaggagcagccccaatcaatcatcctacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctctttcgatgacaccatcaattaaccttccagcaccgggcaggcatcacaccctatacgtccactttcgtgtttgcagagtgctgtgtttttaataaacagttgcagccagctggtatcttcgaccggttcaaccttcaggggctagcccttacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagcccacctctcgatgaaccttcttccgcttacacaacgctcccctacccaacagaataaattctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaagccgggatggccccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactattcgcccagttaagactcggtttcccttcggctcccctattcggttaacctcgctacaaaatataagtcgctgacccattatacaaaaggtacgcagtcacaaggttgccctcgctcccactgcttgtacgtacaaggtttcaggttctatttcactcccctcaccggggttcttttcgcctttccttcacagtactggttcactatcggtcaatcaggagtatttagccttggaggatgggccccccttcttcaaacaggatatcacgtgtcccgccctacttctcgttagcttagtaccacaatatggtttttagatacgggattatcaccctctttgattgtgcttcccaacacattctcctcactatattgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagatttttttacaaaacaggttttgtttttagagtttccttttcagttctctctttcactttactgttttgcctactcagactttctctcgaaaatctcttgttttcagcttgtttccaattttttaaagaacagtaagacaatctaataaagttatctttaattggcgtccccacggggattcgaaccccggttaccgccgtgaaagggcgatgtcctaggcctctagacgatggggacatcaattaaagatactctattttctttttatcttttaacgtttatttttcaacgttgctttcgcttcgtttttaatcttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtactattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctataaataaaacactacttaaaaaagtaatgatgaattttcagttaagcacctattaagacttcaaaattaaaaatagttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagagattttcaaatcccttgcaagtacttttttgtaaaaatatttaaaaaaatgatcttttgatggaaatataaacattttattaaaaagtgcggttagaatagtcaaacttttattgctattatttcttacgtaatgaaacttctccaccattaaacatctgaattttattgccacataatacttttaaataaccacgttcatctatgccttgttcaatacctgaaataacgccttgctcagtaagcacatttatttcactatttgaaaacgcattatatgattgccatgcttgttgaaattcctcatcaataccattttgttcaaagatatttaaacgtgtatataaatgttgtataagtttgggtaataaagtttgtcgctctacatcaggatcaatttcacacacttccgcataaggctgactaatttctgtttgttttgacaacgacacattaatacctatgccaatcactaaattgagcatgccatttttatgattagcaatttcaactaaaatgccacctaactttctttcatcaaacaaaatatcatttggccatttcacttgtacatttagcacttccgcaatcgccaaaccgatgactaaacttaacccctcaattgattttttaggatcaaatgcccaataaaaactaaacatgatttgcccggcaaaaggcgataaccattggcgaccacgccgacctcgtcctgcagtttgatattcagccacacaaagatcgcctttttttaatgaaagaatattttgtagtatccattcatttgtagaggaaataatcggctgataatggatactataaggaaaaagtgcggttgaaatttgctgaggatttaataaaggaagcattggcactaagcgataatcttgtccatcaacgagaatatccaaaccaatttcacgtaattgttgaatatcttcctctagatttttagaaaatttttccaattcagaccgcactttcggctgacaatccgctaaatatgtcaataacgtaaaattcatcattcattccttatggcaaatagtatgaaaatcatagcataaatcctaaaattnngttttcaaaataaagtgaaatctgtataatctcgtcgcaatattttttaacttcaacttattagcgagaatattgcaatgtcattacgcattaaacaagangcccttacttttgacgatgttctactcgtcccagctcactcaactgtgcttccaaatactgccaacctttcaactcaacttactaaagaaattcgtttaaatatcccaatgctttcagcagcaatggataccgtaactgaaaccaaacttgcgatctctttagcacaagaaggcggtattggctttattcataaaaatatgacgatcgaacgccaagcagatcgcgtgcgtaaagtaaaaaaattcgaaagtggtatcgtttctgaaccagtaactgttttaccaaatttaacgcttgccgaacttgctgaaatggtgaagaaaaacggatttgcgggctaccctgttgtagatggggaaaataatttaatcggtatcattactggccgtgatacacgtttcgtaaaagatttaagcaaaacagtttcacaagtaatgacgaaaaaagaagacttggtgaccgtaaaagaaggggcgagtcgcgaagaaattttggaattaatgcatcaacaccgtgttgaaaaagtattagtggttaatgatagtttcaaacttaaaggtatgattaccgttaaagacttccaaaaagcagaacaaaaaccaaatgcatgtaaagatgaattcggtcgtttacgtgtcggtgcggctgtaggtgcaggtgctggcaacgaagaacgtattgatgccttagtgaaagcaggcgtagatgtactattaattgattcttctcacggtcactcagaaggcgtattacaacgcgttcgtgaaactcgtgcaaaatatccaaatttgcctatcgttgcaggtaacgtagcaacggctgaaggcgcaattgcattagcagacgcaggtgcaagtgctgtaaaagtaggtattggtcctggttcaatttgtacaactcgtattgtaactggcgtaggtgttccacaaattaccgctatcgcagatgcagctgctgcattaaaagatcgtggtattcctgtaattgctgacggtggtatccgtttctctggcgatattgcaaaagctatcgctgctggtgcaagctgtgtaatggttggctcgatgtttgcgggtacagaagaggctccaggtgaaatcgaactttatcaaggtcgtgcatttaaatcttaccgtggtatgggctcattaggtgccatggcgaaaggctcatcagaccgttatttccaatcggataacgcggcagataaactcgtaccggaaggtattgaaggccgtattccatataaaggttacttaaaagaaatcatccaccaacaaatgggtggcttacgttcttgtatgggcttaacgggctgtgcaactattgatgaactacgcaccaaagcggaatttgttcgcattagcggtgcaggcattaaagaaagccacgttcacgatgttgctattactaaagaagcacctaactatcgtatgggctaatctttaaggtgggctttagcctgccttttgctgtttaaagtgcggttggtttttgcaaagttttaaataatatgaaccgcttacactatcaataataagagcattataaatgacaaatatccactatcacaaaatcctaatcctcgactttggttcacaatacactcaactgattgcgcgtcgtgtgcgtgaaatcggtgtgtactgcgaactttgggcttgggatgtaaccgaacaanaaatccgtgaatttgctcccgaactttatcaaggtcgtgcatttaaatcttaccgtggtatgggctcattaggtgccatggcgaaaggctcatcagaccgttatttccaatcggataacgcggcagataaactcgtaccggaaggtattgaaggccgtattccatataaaggttacttaaaagaaatcatccaccaacaaatgggtggcttacgttcttgtatgggcttaacgggctgtgcaactattgatgaactacgcaccaaagcggaatttgttcgcattagcggtgcaggcattaaagaaagccacgttcacgatgttgctattactaaagaagcacctaactatcgtatgggctaatctttaaggtgggctttagcctgccttttgctgtttaaagtgcggttggtttttgcaaagttttaaataatatgaaccgcttacactatcaataataagagcattataaatgacaaatatccactatcacaaaatcctaatcctcgactttggttcacaatacactcaactgattgcgcgtcgtgtgcgtgaaatcggtgtgtactgcgaactttgggcttgggatgtaaccgaacaacaaatccgtgaatttgctccaacgggtatcattctttctggcagtcctgaaagcacaactgaagaaaatagccctcgtgcaccggaatatgtatttaatgctggtgtaccagtattaggcatttgctatggaatgcaaacgatggcgatgcaacttggcggcttaaccgaaacgtctgatcacagagagttcggctatgcttccgtttctcttgaaaattccaccgcactttttgcaaatcttaacgataatttaaccgcttctgagccaaaattagacgtttggatgagccacggcgataaggtaacgcgcttaccagaaaacttcaaagtaactggcacaacgctaacctgcccaattgctgcgatgtctgatgaaagccgtcgtttctacggtgtgcagttccaccctgaagtaacgcatactaaaaaaggcttggaattattaaccaacttcgtagtaaacatctgtggttgcgaaaccaaatggacagcagaaaacattatcgaagatgccgttgctcgcattaaagagcaagtgggcgatgatgaagtgattttaggcttatctggtggtgtggactcttctgtggttgcattacttttacaccgtgctatcggcaaaaacttacactgcgtatttgtggataacggtttactccgcttacacgaaggcgaccaagtcatggaaatgtttggcgataaattcggtttaaacatcactcgtgttgatgctgaaagtcgtttcttaggtgaacttgcaggcgtatctgatcctgaagcgaaacgtaaaattatcggtaaagtgttcgtggatgtattcgatgatgaatcgaaaaaactcactaatgtgaaatggttggcacaaggtacgatttaccctgacgtaatcgaatctgcagcaagcaaaactggtaaagcacatgtgattaaatcacaccacaacgtaggtggcttaccagactatatgaaacttggtttagttgaacctttacgtgaattatttaaagatgaagtacgtaaaatcggtttagcattaggcttaccagctgaaatgatcaaccgccacccattccctggcccaggcttaggtgtgcgtgtattaggcgaagtgaaaaaagaatactgcgatttattacgccgtgcggatgcgatctttatcgaagaattacgcaacagcggttggtatgaaaaaaccagccaagccttcagcgtattcttaccagtgaaatctgtaggtgtgatgggcgatggccgtaaatacgattgggttatttccctacgcgcggtagaaacaatcgattttatgaccgcacattgggcacatttgccttatgatttattaggcaaagtgtctaaccgtatcatcaacgaagtgaatggaatttcccgcgtcgtatacgacatcagcggaaaaccacccgcaacaatcgagtgggaataaaaaatcactttttcagatactttctaattatttcagtaactttaataagtgcggttaattttcaccgcactttctttttgtttaaaagcccttctatgccaatcacaatgagacttaaccaaataggcacataagtaaaatagtcacttgtggttatttgattatctagcacaaagacagctattaaaaaaagcaatatgggttcaatataactcaacaccgcaaaaatactaactggaatttgttggcttgattttaagttggctgaaagcgaaatcgcactcacaataccaagtgctggtagcaataaccaataacgatattcttgcgtaaccaaagaaagcgtatcgctttgagaaagaatataaataaaacaaggaatcgaaattaaaataatatccaatgtaattccttgtagagcagggattttcatccatttacggcttagataataaaatggataaaccgtacaaacccacaagcttgtccatgaaaaactttgagtgtgccataattcatgtgcaacaccgcagcagccagtaaaagcgcgattttctgaataaatgataaacgttcttttaaccaagcccatcctaaaacagccataatcagcggaaaaagaaaatatcccatcgcaatatttatcccttcgccatttagcggtgcccacataaagagccagaattgacttcccgcatctagtgtccccagtaaaaataaaacccaacgcgtccaactttttcctaaagttgtcgtaataagagacaaaagagagcggcaaccaatagtcggaaatagaattaaaagtaacccaaagatcatggtcagcatacgccacgcaaaaacatccgttccgctaagtggttggagccatatactaaataaatacaatatgccaaataaacattgtgaaaaaatgcacaataatatgccttgagtgactactttcatcttgaacttcattcatctcatcaatgtgattattataaaagcccaaggcaataaaaaatctcaactttattttttattgtgataatatttttctcaatagttacatttttgagaaattatcttatgcaaacactggataaattagatcgtcatattttgaatgtattacaacaagatgccatgattccgttaaaagaactgtcagagaaagtgaatagttccgttgcaacctgtcaacgacgtgtgcaatcattaactgattcaggcattattacaaaacgagttgcagttgtttccccaaaagccgttgggcgtacgattagcgtatttgtcatggtcgaaatggataatcaacattcttattatcaagagcaatttgaacggaaaatgcgtcaagaagacgaagtggtgagctgttacgaaatctcaggggactatgattttatgttgctactccatgcaaaagatatggaaagctatcacgcattcacacgccgagtattgacgggtgaatttcatgtaagaacttataaaagtttatttgtaatgaattttaccaaagcagatagtggaattatcttatagaacaagtgcggtaaatttttaccgcactttgtgtatgattagtttagttttgtcgtttgttttaagaataaatacccaagtattgccgaaaccgttgatccaagtagaatacctaaacgagaaagagtattgacactttcccccgcattagcatcaaacgcaaggcttgctaagaacattgacatcgtaaaaccgattccacataaaaccgcaacagcaaaaatttgtttaaaattaattccatccggtnatttagctaatcccaatttaacagaaatataactaaatccaaatataccgactggtttaccaataattaaaccgcttgctatagccaataataatggcgacgaaatcatattcacatctatgcctgcaaaactcacaccagcattggcaaatgcgraaagtggtaaaataacgaaagatgaccaagaggctraaatatgctcgaaatcatctaatgggcgttctccttttttacctttcaatggaatgctaaaaccaataataacgcctgctaaagtagcatgcacaccagactttaatacggaagcccataaaattgcacctacgaccatataagcgcaaagtgcagaaactctgaaacgatttagtaatatcagcacaataattgccacggcagaaaaaattagtgcttgcacactcaatccgtgcgagaaaaataatgcaataacaactatcgcaccgaggtcatcaataatagcaagggcaagtaaaaatattttcagtggaagtggcacttgtttactcaataacgccataattcccagtgcaaaagcaatgtctgttgccattggaattgcccagccattagctaaacttggatcttgtttagcgataaaccaataaactacagccggtataaccattccgccaatagctgcaatagcagggaaaatagcttgttgataggtagaaagcgcgccttcaaataattcttttttgacttccattcccactaatacaaaaaacaccgccataaaaccatcgttaatccagtgaattaaggttttattaattgagaaactaccaatttgtaaacttacaggcaaatttaaaaaatcattatattggttgcttaacggcgaattagccagcaacatcgcaacaacagctgaaaaaagcaataatataccgccagcagattctaatttaaaaaaacgttggatcagttttatcacataaacccctttaaaaatacatagcaaaaaattcacaaaggaagcatcctagcatattttcgaagttaaaggaaaaagtgcggtagattttgtcgggatttttagcgaattgtcgataaaatgccatatattgtgacaaaattcacatttttaattttacacaatagagattttatctactttgtagtagaatgcggaccttttatttttagaatcaaaaactatgttttcacgcaaagatattatcgttttaggaatgatgatcttcgccttatttttaggtgcgggtaatatcatttttccgcctatggaaggattttcctcaggacaacattggacgagtgcttccttaggctttgttttaactggcgttttaatgccatttattacgcttgtggtggtagcgattttaggtcgtggcgaagaacttactaaagatttaccaaaatgggctggcacaggtttcctcgttatactttatttaaccattggctctacctttgcaatgccccgcatcactaatgttgcttatgaaatggcgtggttgcctttaggcttaacagaaaataatgcgaatgttcgttttgtattctcactcatttttaacttaatcgcgatgggctttatgattagcccaaatacgatcatttcaagcgtgggtaaatttatgacaccagctttattagtgttacttattgctgtagcaattaccgtatttatttcgcctttatctgaaattcaagcgccaagtaatgcttatgaaaatagccattctttattaatcggtttaactagcggctatcaaacgatggatgtacttgcagccatcgctttcggtggaattgtcgcccgagcattatcagcgaaaaatgtgacaaaaaccaaagatattgtgaaatacaccatttcagcaggatttgtttcagtcatcttacttgcgggtttatatttttcgcttttctatctaggcgcaactagtgctgcagttgcagaaggggcaacgaatggtggacaaattttctctcgttatgtaaatgtcttattcggttcagctgggacttggattatggcaggtattattgtgttagcgagcttaacaacacttgttggtgtaactagcgcatctgctgattatttttcaaaattctctgtgcgtttttcttatccattctgggccgcactttttaccgcaatgacaatcactgtttcacaatatggtttaacggatctacttcgcataacgatcccagccttgttattaatttacccagtagccattgtgcttgttttattgcaattcttacgaaaaaaacttccatcaataaaatttacatacaatagtacattgctcgttacagtttgttttagtttatgtgacagcttaaataacgttaaaatgttaccagaaagcatcaattcattattgaaacacttccctctttcatctgaaggaatggcttggttggttccgactttagtaatgttagttgcaagcatttttattggaaaagcattgcataaaacccattcttaatctcacaaagtgttttatttatcagccctgtgccgtaaaactccgtccttcagggcggagatataaggcacagggctgataaatttctaaccgcactctttcaaaaatcaaattaatttaacaggtacttttacgactaattttttaattttttctgtttttccattcactacacagcaaggcttgtgcggttcataaggatagaatacagcgaacatttttggtttcattgtgacggtgaatttatcatcaatatctgcacaaagttgataatcatccgcttcgttgtaatcttcatacttagataaattcggataggttgcacccacttcgatattttccgtgccacgaataagcacttgtacatctaagtattcatgatgtaattctgcttttttactgcttggttctgcagtttctggttccattacgttcatataaatttgatcgttaatatcatggcgaccattctctaacgcattcaaatctaacgtatttaaataatcacatacttcagcaatcacttttggtaaaccaactttaaaatttgggttggttaaactgctaataatcatagaattttccttatagtggataaaagttacactatgataccaagtcagttaaatgaaataaagccaccgattacatcatctctcttgattaatccaattagctcttgtagtaccgagtggaagagagcaaatatcttgccaacttattgacgcataaagtctaaacaatgaaattacggcattaacacaagcattttcagaaaaaatattatcaagaggcttatgaggacctgtaaaatgaaaaatattaggagaagtatcaagagtattaattgaaatcatatgaactaattgtaatgttgaatagcgtttagcaaaataaagttgaagatcattttgccacgattcagaaatatctcctgtatgtaaaataaaaacagagagattttcattgtgcattaataaagatttcagtgtaatttctacattaaggaagataattagcatcactagccatcattacattatatttcatataaaagaacctaatttcagagagracaatcaatttttaggaggaaaatactgtcgaaacaatgataattaagttggtaatgtgaaataaagttagccattaaagccaaacatcctgtataatgcacgggctttattttctacattagcgtgcggctatcaaaagaaatttttaaacgcccaaagtgcggtcattttttcgaaagatttcttttgctagtcgcaatctgggaaataaggcattgtttttaatataaattttaaggaaaacattgtgaatccaattgttaaacaatttaaatacggtcagcataccgttactctagaaactggtgcgattgcacgtcaagcaacggctgcggttatggcaagcatggacgataccacggtattcgtgactgttgttgctaaaaaagatgtgaaagaaggtcaagacttcttcccattaaccgtaaactaccaagagcgtacttatgcggcgggtaaaatcccgggtggtttcttcaaacgtgaaggtcgtccatctgaaggcgaaactttaattgcacgtttaattgaccgtccaattcgtccattattcccagaaggtttcttcaatgaaatccaagttgtggcaactgtggtttctgtaaacccacaaatcagcccagacttagtggcaatgatcggtgcttctgcagcattaaccttatctggtgtgcctttcaacggccctatcggtgcagcgcgtgttggttttatcgacaaccaattcgtattaaacccaactatggcagaacaaaaacaaagccgtttggacttagtggttgcaggcactgacaaagccgtattaatggttgaatctgaagctgatattttaactgaagaacaaatgttagcagcggtcgtattcggtcatcaacaacaacaagttgtagttgaagcaatcaaagaatttgcaaaagaagcgggcaaaccacgttgggattgggttgcaccacaaccaaacacagatttaatcaacaaagtaaaagcgattgctgaagcacgtttaggcgatgcataccgcattactgaaaaacaattacgttacgaacagatcgatgcgattaaagcggatgtaaytgcgcaaatcacagctgaagatgaagaaaycagcgaaggtaaaatcgtggatattttcaccgcacttgaaagccaaatcgttcgtggtcgtatcattgcaggcgaaccacgtattgacggtcgtaccgttgatactgttcgtgcattagatatttgcactggtgtattaccacgtactcacggttctgcgatttttactcgtggcgaaacgcaagcattagctgttgcaaccttaggtaccgaacgtgatgcacaaatcattgatgaattaacgggtgaacgtcaagatcacttcttattccattataatttccctccatattctgtaggcgaaacaggtatgatcggctcgccaaaacgtcgtgagatcggtcacggtcgtttagcaaaacgtggtgtagcggctgttatgccaagccttgcagaattcccgtatgttgtgcgtgtagtatctgaaatcactgaatctaacggttcttcttctatggcgtctgtatgtggtgcgtctttagcattaatggatgcgggcgttccaatcaaagctgctgttgcaggtatcgcaatgggcttagtgaaagaagaagaaaaatttgtggtgctttcagatattttaggcgatgaagaccatttaggcgatatggactttaaagtggctggtacacgtgaaggtgtaaccgcccttcaaatggacatcaaaattgaaggtatcacccctgaaattatgcaaattgcattaaaccaagcgaaaagtgcacgtatgcacattcttggtgtaatggaacaagcaattcctgctccacgtgctgatatttctgactacgcaccgcgcatctatacaatgaaaatcgatcctaagaaaatcaaagatgtgattggtaaaggtggtgcaacaatccgttcactaactgaagaaactggtacatcaattgacattgatgacgatggtacagtgaaaattgccgcagtagacagcaatgcagcgaaaaacgtaatgggacgtattgaagaaatcgttgcagaagttgaagctggcgtaatttacaaaggtaaagtcactcgtcttgctgattttggtgcattcgtcgcaatcgttggaaataaagaaggtttagttcatatttctcaaattgctgaagagcgtgtagaaaaagttagcgattaccttcaagtgggtcaagaagtaaacgtaaaagttgttgaaatcgatcgtcaaggtcgtattcgtttaacaatgaaagacttggctccaaaacaagaaactgaaattaaccaagaagattctgtcgaagaacaggaataatcttggaatatagaatcaaaacttggtagcattcgctgccaagttttgttgttttccaacttttaggcataaagaaagcaaatgcggtgttttcgcttatctcgccattttatagtctatttatttagcttatgtgcgatcttactccttgctggctgtgttcagtctaggggcggttttgtgtctaaaaatcatgtcgtgttggctgaacaaaacccgaatactcactttgaacaagaagtgatgatcgtgcgattaagccaagtactactggttggaaaaatgagtaatgaagaacgcgcatcgctacattttgaacgtggcgtactctatgattctcttggattatggggacttgctcgttatgatcttactcaagcccttgcattacagccgaaaatggcatctgtgtacaattacttagggctttatttattgcttgaagaagattacgacggcgcattggatgctttcaatacggtgtttgaattagattcaggttatgactatacccaccttaatcgtggtttaaatttttattatgtagggcgctaccatcttgctcagcaagatttcttacagttctaccaagccgataaaaaagatccctatcgtgtcttatggctatatttgaacgaacaaaaattaaaaccacaagaagcccaaacaaaccttgttgaacgagcaaaagggctatcagaggacttctggggtacacatatcgttcaatattacttaggacacatctctgtagaagaattgcaacaacgtgcaagtgaatttgccgaaaattcacaacaatatgctgaaattctcacagaaacctatttttatctagcaaaacaaaaactcaatgtagggctagtagatgaagcagcagctttatttaaactagctatggcaaatcaggtttataactttgttgagtatcgttttgccgcgtttgaactcatgaaattaaaaccggttcaaacagaagacgaaaaagaagagaaaagtgcggtaacaaaagcgattgttttctaaaaatcaatccaaaacttaccgctctttgcagtagaacgaatagaaaaattcattcgctctgctcaacttaataaaccgaaggcctctttgagctttccttatttatattcgagtattttaatgactgacaaaattactttcaatgacttaggcttacctgagttcatcttaaaagctgtttctgacttaggttttgaaacaccttctccaattcaacaatcttgtatcccgcatttgctcaatggcaatgatgtgctaggtatggcacaaacaggtagtggtaaaaccgctgcctttgcactgcctttactcgcgcaaattgatccaagtgaaaaacatccacaaatgttagtaatggcacctacacgcgaacttgctattcaagttgccgatgcgtgcgaactatttgttaaatatgcacagggcactcgcattgttaccttatatggtggccaacgttatgacatccaacttcgtgcattaaaacaaggcgcacaagtggttgtgggtacaccaggccgtattcttgaccatattcgtcgcggaacattaaatctttctgaacttcgttttatcgtattagatgaagccgatgaaatgctacgcatgggtttcattgatgatgtagaaaccgtcatggcagaattaccagaaaatcatcaaactgcgttattctctgcaacaatgcctgaaccgatccgtcgtattacgaaacgttttatgaatgatccacaagaagtgaagatcaaagtgaataacgaaaatgccccagatatcgaccaaagttgttggtatgtacacggcgtgcgtaaaaacgaagcccttcttcgtttcttagaagtggaagattttgatgcagcgattatctttgctcgcactaaaactggtactttagacattacagaactacttgaaaaaaatggtttccgttctgccgcacttaatggtgatatgacacaacaattacgcgaacaaaccctcgatcgcttacgtaacggcagtttagatattgttgtggcaaccgatgtggctgcacgcggtattgatattgaacgtatcagccttgtggtgaactacgacattccgcttgatgcagaatcttatgtacaccgaattgggcgtactggtcgtgcaggtcgttctggccgtgctttattatttgttgaacctcgcgagcgtcgtttacttcgtaatattgaacacctaatgaaaaaaggtatcaatgaagtagaattgccaaatcatcttgtgttacaagaatgccgccgcaaaaaatttgtcgccaaaattacgaaacaactcgagcatcacgatttagaacaatatcgtagtttattagaagacttattcacagccgatcaggatcaagaaaatattgctgcagcaatgttgatgctgcttcaaggcaaacaaaaactcattcttccacctgatccaccaatggaaaaacgtcgtcgtgaacgtaatgatcgcggtgatcgccgtgaaaatccacgttcagctgaacgtcgtggcgaacgtaaaggctatggaaatccacaaccaatggatttatatcgtatcgaagtcggtcgtgcagatggtgtagaagttcgccatatcgttggtgcgattgctaacgaaggcgatattaacagccgttatattggtcatattaaactttatgatgattacactaccgttgaattgccacaaggtatgccgaaagaattattgcaacaattcgctaaaacacgcgtattgaataaacaaatgcaaatgtctttcttaggtgcagtaaaatccgataattcccgtggcagcgatgattttaacggtaaacgtaaaggtcgtggtggcgatttccgtggagagcgcggacgtgaacgcggcaatgataatcgtggaaatcgtaaatttaatgaaaaaagtaaccgcacttttagcgacaaaccacgccgtgatcgtagatcatcattctaaaaataaatcgtctgatattttacatacacttagccccttgaacctcaagggggcttttattgtctatagtgaaagttttggctacaatcccataacttttttatataggaaaaatcattgaaaggtctttttttacgtattattactgctctagcgttattattttgggctattgatatggtgttcccatggcaatttttacgtcatactgaagaaaatcattatactgcaattcaagctaggggatcactttatgtaggaacaataaataaccagatttcttattttattaataaagatagcgaacgaggctttgaatatgaattagccaaagcatttgctgatactttaggcgtagaactcgaaatgaaaattttcgataatcaagagcagttatttgatgaacttgataaacacaatattgatttagctgccgcccaccttttataccatcctaaaaatgcggaacgtttccaaataggtcctgcatatcattctgcttcatggcaattagcttatcgaaaaaatgaaaatcgtcctaaaaatttaggtaacgtaaagaaagatatttatatctcaaataatttagcattagaagaaacgctaaaagaattacaaaaacaatatccacaattaatttggaaaagaaatcaagcacttactcaagaagaactattactacaactggctgaaggcaaaattccttacgttattgcaaattctattgatattgctgcaattcaacaaatcaaaccagagttagccattgcctttgatattactgatgaagcaaacgttcactggtatttacccaataacccctaccgcgatctacaaacggctttactcaattttatgaataatgccgaagaaacgggacttttagataatttaaaagaaaaatatttaggacatatttcacaatttgattacgtggatacgcgctcttatatgaacgcaattgaaaataccctgccacaattctcaccgctctttgaaaaatacaaaggtgaattagattggcgactactcgcagcagtggcttatcaagaatctcattggaatcctgacgcaacatcgccaactggagtacgtggcataatgatgctcaccaaaaataccgcacaacatatgaaaatcagtgatagaacagatcctgaacaaagtattaaagctggttcagagtatttacactggttgattagtcagcttcctgaaagcattgaaaaggaagaaagaatttggtttgccttagttgcctataacataggactcggtcacttaattgatgcacgccgtttaactcaaaatcttggaggaaatccagataattggttcgatgtgaaaaaaaatctgcctttattagcagaaaaacgctattattcccaactgaaatacggctatgcgcgaggctatgaagcccatcaatatgtagaaaatattcgccgctatatgaatagcatagtgaattatcatcgagtccaagaaaatcaaacaacgaatgataatgccaacaacgaaagtgcggttaaaaatttagaagaaataaaagaaaataaggattaataaaatgttaaaacgtaaaacttttcttaaaaagaaagctaatttacaacaaagttctttatcacgtaatctacgtttaagacgtttaaaacaccgcaaacaacaacaattttcgagacattcattacaatttgtcgtacaagaaatttgttgctaagtaatctatttttcttatcaaaataaagaaaaaataaccgcacttttttatgtaatttatatcattaaagtgcgatctttgttttacaataatcgtaaaatatattgtgaaattttatagattaatcaatattttattctaattttatccctaagtttccaattttcacaccgactagaccaatcgagacgggatcaaaataatcccctaaaaatttgaacaattcatttaactctgtaaaagaacgctgaatttttatttgatcctccactttacgcacaaattcatagcgtatgttattttccttcaaaataagctgttagagttaaataaatcgtttcaaagaaatggctttttgccccctcctctccgggatcactaatacgcacattccacgtattattaagtagaatttgaggctgttttgacatattttactccttgctatttttaacctaagaaaaacccgattataaagtttctgtaatcaaaaaaatttataatcgggcttttcaaatattttccctgggtgtttcgccttacgttggtaactgcctttccctttacgttttttctcaacacgctgacgaaataatttatcgcctagcaatgccatcactgcattatcttttatcacgcctcgagtgtgcaaataaacggtttcattttcaaccgcacttttttgtttctttctcataaattttccttaaaaaagccgcggaaggatttccacggctggtgtattatacatgcaaacgtttaaattacaaaatctcaagtacagtttctggtggacgcccgattttagctttatcgccattaataacaattgggcgttcaataagtgctgaatgttcacttatcgctttaaataattctgcttgagaaagatctaaattatctaaatttaagcttttatatagttcatctttcgtgcgcatcatttggcgaacatcatcaattcccaattttttggcaatgctttgtaattcattaacggaatactgcttttgcaaatacagttcaataatcggctgaatacctttattttctaataatgctagcgtttcacggctttttgagcaatgtgggttgtgataaataataacagacataggatttcctcttagtagctataaacactgtaaattttaacttataatggcaaaaaaatacttataggaaaagaaattatgctagaaatgttaaaaagctggtactcacgccgtttaagtgatcctcaagcgatgggactattagctatattattatttggctttatctccatttatttttttggagatttaattgcgcctttgttgattgctctagtactatcctatttacttgaaataccaatcaattttttaaatcaatatttaaaatgcccaagaatgttagcgacaattcttattttcggtagttttattggtctagcagcagttttctttttggtattggtgccaatgttgtggaatcaaactatttccttattaagtgatttgcccgctatgtttaataaatctaatgaatggctactcaatttacctaaaaattatcctgaacttattgattattcaatggtagattctattttcaattctgtgcgagaaaaaatccttggttttggcgaatctgctgtaaaactttctttagcctctattatgaacctggtttctttagggatttatgcctttttagtgccattaatgatgttttttatgttgaaagataaatcagaacttttacaaggcgttagccgtttcttaccgaaaaatagaaatctcgcatttaaagatggaaagaaatgcaacaacaaatttctaattacattcacggaaaattattagaaatactgattgtcactttaatcacttatattattttcttaattttcgggctaaattatccgctcttattggcttttgcggtgggtctttcagttctcgtcccttatattggcgcagttattgtcacgattcctgttgcattggttgctttattccagtttggaatcagcccaacattttggtacatcattattgcttttgctgtaagccaacttttagatggaaatctccttgtgccttatttattttctgaagccgtcaatttacatccactaattataatcatttcagtattaatttttggcggtttatggggattttggggtgtattctttgccattcctttagccactttagtaaaggccgtaataaatgccttacctcaagattaaataatctttgaattttaagtagtctatttcaattagagctttatataaataaaaaatagttaatcgtaaattttcgattaactatttttttaatttattctaaaagtaaattaactaaggtaattcatcaatttctttatctactttaggtgggatcatatgttcacgacgtaaaccaacatcgtatgcaatggcaatggcaacaaaaatcgaggaataagtaccaaatccaatacctacgagtaaagcaagtgaaaagttatgaatggaaggaccaccaaagaagaacaatgccatcacgacaactaatgtagtaaccgaagtaatgatagttcttgataaagtttgcgttaaagaaatatcaataatatcaatcgtatccaatcgtctaatttttcggaaattttcacgaacccggtcaaataccacaatactatcgttgatggagtaacccaccacagataaaatcgctgcgacaaaagtaagatcaatttcaatttgtaatgcagagaatacccctagcgtaataatgacgtcgtgcgcaagagaagcgatactgccaaagcctaaacgccattcaaaacgtgaccccacataaataagcaccattgctaatgtcgctaaagtcgcatataccgcaccttgtgctaattcttcaccaacatttgggccaacgaactcaatactgcgaatttgaatgtctttatctacattctgtagcatacttttgacgtgttcaccaatggtagaatcattattacttgcaggtaaacgaatcatcacatcctgaaccgatcctgtggtttgtacaattgggctttcaattccattttcgtgaagtttactacgaatttgttcaaggttagcggactgcgagaagtgagtatcaaataccactccaccagtaaaatctaagccccagttaaatcctttggtaataataaaaaatagagaaattaccatcaaaagtgcggataatatataacccaatttacgcactttcataaattcagtcaatgggaacgggagctttatcccattgatttcacggataaaatgtccgtctttatcttttgtaaaaagtttcatcatttcccgcctaaattaataattttttaagttgtttaccaccgtaaagggcattaactaatgcgcgagttcctgtaatcgcggtaaacatagaaatcgcaacaccaagtgaaagcgtaatcgcaaaaccttgaattgggcctgttcctaccgcgtatagaataattgcggttaagattgtggttaagtttgcatcaaaaatagaagtaaatgcgccgttataaccttcattaatggcttgctgaattgaacgaccattacgaatttcttctttaatacgttcaaaaatcaatacattcgcatctactgacatacctaaagttaaaacgatacccgcaatacccggcattgaaagtgtcgcgccgggtaaaatagacattaatcccacaagtaatacgatattaataacaagtgcaaaacttgcaatcacaccaaacattttgtagtaaaacaacataaaggcaataacagcaactaatccccaaagactcgcattaatcccttgctctacgttttgcgcacctaatgatgggccaattgtgcgttcttcaacaatttgaattggtgcaattaatgcaccagatttcaataaggtagaaagattatgtgcttccgcaatgctatcaacaccagtaatttggaaattagaaccaaaacgtccttgaattgttgcaacattaatcacttcttcatgcttttctaaaatagttttaccattttcatcttttttaccgttatctttatattcaacataaagcgttgccattggtttcttgtaatattttttagtggtctgagacataatctcgccaccttcgctatccaaggttacactcacttgtggcgtgcttgaatgctgatctaaaccagagcttgaattaataatatgctccccgcctaatacggcacgtttaaataatgcaacaggatgaccttggcgatcatatttaacttccgaatcagctggtaacatattacgagaaatagcatcagccgtaacattttgatttacgatacgaaactcaagtgttgccgttgcccctaaaatttcttttgcacgtgcagtgtcttgaacacctggtaattcaatcacaatacgctccgcaccttgacgttgaattaccgcttctgcaacacctaattcagcaacacgtttacgtaaaatcgttaagttttgctcaatggctaagtcgcgtgcttcatttaatgctgcagtagatagccctaaattaatactatcagcatcaggctcagtaatatctaatgttggatgtaattggcgaataattcgctcagctttagcacgctggctcacattagctaaggttatcaacgtaccaaaatgctcagtatttttaatggcagtatattgaattttttctttacgaagttcgccacgcaaactgtcttgtaattgctcttggcgttttacaagtgtggcattcatatcgacttccatcaaaaaacgaaccccaccgcgtaagtctaatccccatttcataggattcgcaccaaacatacttaaccaagctggagtggctggagcaagatttaatgcggtggtgtaattattgccaagacgttcagcaattttatctttagcaagaagttgatcatcggtattagtaaaacgagctagaattgagccattctcaagcacgatagatttggttggaagattattggttttaagcacatcttgaacttgtccaagcacgctagtatttgcttcttgaccgcgtgtaccggaaatttgcaccgcaggatcttcaccataaatatttggaagagaatataaaatcccgatggccacaataaaaataaccatcaaattcttccataatggataacggtttaacatagttttccttttcttttctaacgcacagagccacaatgcgtggctctggaaaataatttaatgttattcttaaagtgattttaatgaacctttaggaagaacgctcacaatgtagttacgattaatcgtaatttctgtcgtgtcgtttaacgcaatcacgatgctatcgctaccttcggttactttagtaattttgccgattacaccaccagcggttaaaacttcagtaccttttgcaagctcagacatcaattttttgtgttctttattgcgtttagcttgcgggcgataaatcataaagtagaaaattaaaccaaagatcacgaaaataaatagcgtggacattgggctttgtgcttccattgtgttttccttattaatttaagttaaaaattttgcgtaaaataccataaattgcttcattgggaaaggcgaactaagcccaatatcctacgttatggcgattaattttattttttcaagataacgataaattctttttccgaagcgtaatattgctcgaccaaagcaacagaattttcttcggcaaaaatagaaaaattttccaccgcactttcaaggtttaagatcaacattagctcatcatttttatccaaattttttaaggcttttttagcacttaaaagaggaatggggcatcgaagtgcggttaaattgagctgatatttcattctttaacttgacgacgagcactcatgtgcttgcccatttcagtcaaaatatccgcacttaagcattcacgccccatttcaaataacggctcttctaaggcaatatgacgatcataaccttgaataaagcgttcaattaaatgtttatcaatatcttgacgttgttcagaaataagctcttctaactgcacagataatgcattccaattttcatgcaaatattcgtgctgtttttctaattcatcaatggaagtttgtgtttgcggagccactttgactaattgagggaaaaaatctaattcttcatcatcgtgatgtaacggtgcggcacgattgaaatagcttaaaatctgctcaacatcatttaatacagcctgagtatagccgtgtttttctagataatcaggcaaaatgcttaactgacgacaaaaacgttttaccttgctatgacaggcataaagcatttcaataggttcattccatgtggcgaattgttgaggttcaagaatttgcataagatttcctttgttaaaaagtgcggtcaaaaaacgttttatttttctaccgcacttttattaattatgatttatccgctaattgtaatggcggaacaggtttgcccatgcgagcatagaattccaccacaaaatcatcaaaacgatcatcttcaatcgcttgacgaatttccgccattaaacgttgataatagcgtaaattgtgaatggtatttaagcgcgcacctaaaatttcaccgcatttatctaaatgatataaataagctttggtgtagtttttacaggtgtagcaatcacattcaggatctaacgggctggtatcatcacgatattttgcattacggattttgacaatgccgtctgtaacaaataaatggccattacgtgcgttacgggttggcattacgcagtcaaacatatcaatgccacgacgcacgccttccactaaatcttctggtttacccacgcccattaaataacgtggtttgtcagctgggatttgtgggcaaatatattctaaaattcggtgcatatcttcttttggttcgcctaccgctaaaccgcccaccgcataaccgtcaaaaccaatattgactaagccttctaatgatactttacgtaattcttcaaatacaccgccttggataataccgaataacgcatttttattgcctaattcatcaaagcgatcgcggctgcgttttgcccaacgaagtgacatttccatagattttttcgcataatcgaaagtcgctgggtaaggagtacattcatcaaaaatcatcacgatatcagaacctaaatcatattgaatttccatggatttttcaggcgaaaggraaatacgctcaccattaattgggttttggaattttacgccttcttcggtaattttacgtaatttacctaaactgaatacttggaaaccgccactgtcagtcaaaatcggacgatgccattgcataaagtcgtgcaaatcaccgtgtttacgcatgacttcttgtcctggtcgaagccataaatggaacgtgttacccagtaaaatttctgcacctgtcgcacgcacttcttctggcgtcatgccttttaccgtgccataagtacccactggcataaatgcaggggtttctacactgaacgtgccctgtggacgttcaaataccaagcgaccacgacgagcattgccgcttgttttatctaattcatacttcatttttgctccaacgaataaacagttcgaagattttttaaacaaaaaagcctgttaaaaaatacaggctttgtgatatcatattttcaatgctctttgagcagaggcggatctactaagatagtccgccagttgccgctgtcgggctatttcgtagatcctgagtttgttaatcatactaaggataaaaatatgactaaatttatgattaagttggtcatcattattctactttgcctgttattgaaaagtagcactggctattagtagttgatgccgacaagagatggttaccgccatctcttgttctttattgtaggtgctgactaattacaagtcaaacaacttattccaatcctctcacattagaatttttattaataaacatcgcatcgccataactaaagaaacgatatttttcttttactgcatgcttatatgcattcatggtatttttataaccagcaaaagctgaaactaacataatcaaagtgctttcaggtaagtggaaattagtaattaagcaatccaccactcggaattttttccctggataaataaaaatagaggtatcagaaaaataaggctcaattaaatctggattgccaaattcttccgcagaaagtgccgcactttcaatagaacgaacagaagtagttcccactgcaattacacgtttgcccgctttttttgttgcgataatcgcattacagacttcttgagaaacttccacatactccgcatgcattacgtgatcttcaatattttccacacgaacaggctggaatgttcctgcgcctacatgtaatgtaacaaattcaaaattcacaccctttgctttgagtttttcaagtaaattttcatcaaaatgtaagcctgctgttggtgctgctaccgcacctggtactttactataaaccgtttgataacattcttgatcggcttcttcatctgggcggtcaatataaggcggcaatggcatatgcccaatggtttgcaacacatctaaaagagcggttgatttatcacttaattccacttcaaacaatgcaccatgacgcgctttcattaccgctttaatgccattattttcgcctaatttatcttcccctaaaaataattcagccccttctttaggggatttcgatgaacgaatatgcgctaagaaacgatgttcatctaacatccgttcaactaaaacttcaattttcccaccgctggctttacgcccaaacattcttgcaggaataacgcgtgtattattaaaaatcaacaaatcgccttcatcaattaaatctaatacatcagaaaaagtgcggtgaaaaatttctccgttttcgccatttaactgtaataaacgacaagaaacacgatcagttttaggataacgagcaattaattcatcgggtaaatcaaagttaaagtctgaaacacgcataacaaaatttaggttaaataaaataggcggtaagtctagtttgaattgaaaatgatctcaagaaaaaatctcccctcggggaagataaaataaccagcaattatgctggtcatttgggattaattataaatttgcttttttagttgcttttacgtttacatcacaatttttaacgatgatgttatcgctagatttacctttttgaattaaatttacaggcacaacagaatcaaatttatctaacgttaagccactatctacattccaaacataatccccagaaacgaaacttgtaaagtcattttgtgatttatcacgagtaaaatctttcgcaataatgccatcgcccacacttaccattgcagcaactggttcttggttttcaaattgatacacagcagtcaccgtttgtttattgcaggaatatacaactgttttatcagtgattgttggaagtgtttgcatttcagctatttgcgcagatgattttgtcatttcaggtgcatcctttgcacaagcagataatacgactgcagcagcaaatgctggtaaaagtttagttaaattcattattaaatcctcttaattaatcccctatatggggtgctacttagatgctcttaattaaataaagttccattattgaaataaaaaaggtgggatctgccccaccttgtttatcaataaacgatacaattatgttgatttttaccaacgataccccaatttcacgcccacattttgctgtttgccgagttgcgaaccttgagatttagaaataaaagcagaaagttggaaatgtaaaatttctgcctttaatcccacttctttttgccaataacgcccaaatgattgtkgcaacatcgtgctatttacagtggtttgtacgttagcgtttgaaacatcaacataattgacaaagaaataaggcttaacgctgatattatttgtcggggtaaatgtataatcaactcgaatgccagcattatagcgattaaatgcaaggctcggtgtttgcactttcacttcttcagattgataattttcacgttcaataaaatatcgattaacacccaaataaggctgaatacccaattgccctaaacggaactgataacttgcattcactccataatttatcgcttttcgatgaatttttcggctttgttcttcagccattttactcgcactaattcccgcacccacatttacaccaaattgtaaatcgccccattgatattgggcaaaacccgacatcatcgttaatgtcgcgtgatttttaacctgttcgtcaaaggtattatctgaacggctatgcgagaaaaccgccccaattcgtccattatctaaggctttttgcaccccaatttgacgcaagtncgttttctgctgataagcacggaacgcatcagaatcatagcgtcttttatcctgtgcgatatttgtccacagggcagattgtgcttgatctacaaaaagacgatccaattcatcttgaacggaaaacatactatttactgttgcagacaactccgataacgcactatttgagtaacggctgatcaattctttttgtttgccttgttcctcttgatcttgaggttcttttttcacttgcggttgggcattaataacctcaagtttgacttcgaatacctttaactggcttagatcaaacggggtatcagaaaacgctgcactcaatgctctttttgaccgccctttttttgtttttggcttacttgtttgtgtttcagtagtctgttcaacttgtttggcttctaatgcgtttaacaggctttgagcagacggggtatcagacaacaccgctcttcttgaccgcgcttttgccttacttttttgtttttcagcagtctgttcaacttgtttggcttctaatgtttgttctgcttgctctgctcttactaaatcattgagcaattcctgctcttttattgggttatgcaagcggaattcgcccttattcttcactaatttataacgtaatgcacctgcatcaacgtggtcattttctaaagtaaatttgagcttatctgataacggtttattatctaagctttcaatcaaagttaattgctcaagggtcacaggttctttgcctgtgttgcgaacagataatgtgtaatcgccctcagcgtcattggataattttaatttatcgcttttatagccaaataaagatgaagtaaattggaatgtgccttgcccgctcaatttaccatttactgtcaatgtgttgaaacgatgttctgccgatgttggcgttgtttccgtctctaatgaacggcggtgacgtggcgcattatttgagctagctgaataagctgaatttaacgtaacagtactattatttagcgttaaattctgcaatgtagtatcgctaggcattgtccaagtcgcattttccaacgtcactgttgtgtctttgtcgccctgaatttggtgccaaaaatggctgttttttaaagaaaattgagcagaatccgttaaatgcacattgccgtttaacgtggcattatttaccgttgcatttgcgtgatttgaaagtttgatattgcctgtttgggtggcattgttgctcaatgtaaattggctgtgatctattaaagtgacattaccattaagttttgctaaaccatgaatattcactgttgcattattagttaaattaatagagccattaatttgtgttatgggtatggaattaataacttttgtatcggttaaattaactgttttacaagtcgttaatcctgtccaatctgaacgcgtgcaaatggtattttgttaatttggcacaacaccaaatgtggcatttgcattattgctgactgtccaatttccctcaattgaagaaacattgcgagaaaccaccgcacttccgcctttaatttggaagttttcagctttaaatgtacggttgawccaatcgtaatcccacacaatttcgccttgtgggataccttccatttctgaccaacgtttgtctaaatgattgtaggcgtggggtgtcggtctaccgctgaaaaatagtttaccttttgtttgggtaatatcgccttttaagtttgtgccacctgaaagtagcaaagtacgatcttctgtggttggtttataaataaggtttaatcgtccattgtgtttatttttatctgtttcgccaaaccaaccgttgtaggcaatttctttgctgtaatcaagtttattaatattctttttattagatggagcagtaatactttcgttcccagtaatagtaatattagcgacttgagttgtattatggttcacaatcatcgcgccctcgtccgtattttggatacgcttaaaggttaatgaatgcccgttaagatctaagcgaccaccacgaaatccgaaatagatattgttaggatcaacttgatctgtactatttaattgaactgttgctcgaccgcttacaatgccaacttctttgaaagcttgtttttgacccgcttcatctgcttgttgatctagaatgactttgccgttacccgcacttaaacttcctaaattctttcccttaccattgactaataaagtgcctataccaattttagataaacgatcattttcaggattgtgaactttccattcaacagttgcatcttgtccaatagatacgcctgcaccttgccaagttatattattttgcttgccttttacaacaaaattaccttcaaagtataatccaccagcaccttgatttatattattttcgattgttaaagttccttttccttggtcgccaaggtaaatattttttccatattccattcttggttggtaaatattatagcctgctgctgctttaacatgttctttagcggtttgatttaacgatggattaaataacttcacagttcctacttctgattttgctttagagccatctttactaggtctagttaaagttaatttacctgtaccatcattatttgatacaaaggaataatgtccatttattgggggaatatagcgttgaaaaacactaggggtatcaaccgcaagaacttcattataaaaccattcttcacgtattaactgaaacccattacctcttccgaaaaaaggatgcccagtttgtaatacagcatttataagccattgtttcttcttcgcatcataaataaacattggcgaaccgctatcgcctttagaaccacccgttggtaatggaccataatgattagggctaactacattaccactaagattgactgtaccattaccatttccactctgagtatgggtatttcctgcagtaagataacgatatgcacctgagacataatatgaactatgtacattcgtttcttcatctttatctgtacgccaatactgacgtcctgagcctatacgtacacgctcaggatagttctctctatcagcatatacttttccatccatatttgttgtcatacccacaggttcagcttcagttacaaatttatgtaaacgaggcatatgataatctccatcataaggatgctttctctcccaagcttgataattatttctttttacaatttgataagtaaagcggtgctgatcagggtttcgtccttctgcaccaaaatcaacatcgttatatccgccgttatgtgccacgctcacaatatactgatcgcctactaatgccgccacgccgttacgcgacaccacggaaaaatcaatcatcggggcttttgtcattgatgtgccaactaattgcccttctttgttataaacctcaatatttttagccccaactgtgaacttccctttattctcggcaaaatcacgataatattggtagtcaatcccaaaataagtatgacctgcccaggcttgtgatgctatccctaatgaaacacaagcggttaaaaaattaagacgaaatacagtttttttcataatgtttatttaattaagtaatttttcgtattaaaaaatacgtggttaaacgactattgaacaataaaagtgcggtgattttctaagggatttcagctaaaaaacgaactaaaaggcacaaaagaaaataaagcagtaaaactatatagtaattaagccaaaatttctaggttttggcttaatacttagtgggtaatcttatcttgcgatggattaatattatatgtcatttatacagataactaaaattaaaacaatatcactaataaaataaccgcactttatgtgagttttctctgaaagtgcgatcattttttctaaggtttttctaaaatcggtttaaggaagcgagcggtgtgggaacttgttactttagcaacttgttctggtgtacccgtcgcaataatttgtccgccgccactgcctccctctgggccaagatcgacaatccagtctgcggttttaatcacatcaagattgtgttcaatgacgacgatagtatttccttgatcgcgtaatcgatgcaatacttcaagtaattgcttaatgtcagcgaaatgcaaaccagtcgtcggttcatctaaaatatataaggttttacctgtatcacgtttagaaagctcagtcgctagcttaacgcgttgtgcttcgccgcctgaaagtgttgtagaagattgacctaatcgaatataggataatcccacatccatcaaggtttgtaattttcttgcaatcattggaatcgcatcaaaaaactcgcgtgcttcttccaccgtcatgtccaaaacttgatggatggttttacctttgtaacgaatttctaaggtttcgcgattatagcgtttacctttacattggtcgcaaggaacataaacatcgggtaaaaaatgcatttcaactttgagtacaccgtcgccctgacaggcttcacagcgtccacctcgtacgttaaagctaaaacgccccggattataaccacgcgcacgtgcctctggcacacctgcaaaaagttcacgaattggggtaaataagcctgtataagtggctggatttgaacgtggcgtgcgcccaatcgggctttggttaatatcaataactttatcgaaatgttctaatccctcgatagattgataaggtgcgtaatccgtcttttccgctctatttaacgcattttgcgcaagtggaaataaagtatcattaataagtgtggattttcctgaaccagacacgccagttacgcaagtaaacaaaccaacgggaatatctaaattcacattttttaagttattacctgatgcgcctttaagtttgagccattttttcttatcaagtgcggtgcgttttttaggaatttcgattttatctgcgcccgataaaaattttcccgtgatggaatttggattgagcataatttcatcggcatttccttgcgcaataacttgtccgccatgcacgccagcaccaggcccaatatcaataatatggtcagctgcacgaatcgcgtcttcatcgtgttccacgacaattaccgtattaccaagattacgcaaatgaattaacgtattaagtaagcgttcattatcacgttggtgcaagccaatagagggttcatctaatacatacattacgccaacaagtcccgcaccaatttgactcgcaaggcgaatacgttgcgcctccccacctgaaagagtttcagcagaacgagaaagagaaagataattcaaaccaacattgactaaaaactgcaaacgctcgcggatttctttaagaattttttccgcaatttgtgctttttgaccagtgagagaaagtgcggtaaaaaattcgagggtttcgccaatgcttttttccgcaattatcggcaaattggttcttccaatatacacattacgcgcttcgggtcgcaaacgagaaccgccacaatctatacaaggtcgattgctaatatttttcgctaattcttcacgcrccgacattgattccgtttctttatatcggcgagccatattattcaaaatcccttcaaaagggtgcttgcgaataaccacatcgccacgatcattcatatattggaattcaatttcctctttgcctgagccatgcataatgatgtgttgaattttctttggcaaagattcataaggggcttcaacatcaaaatgataatgtttcgccaatgatgtaagcatttgataataatagaaattacgacgatcccaaccttttaccgcaccaccagcaagagaaatagttggattttgcaccacacgatcttcatcaaaatattgctgcacacccaagccatcacaagttgggcaagcacctgcaggattgttaaaggaaaacaaacgaggctctaantctggcacagaataaccacaatgcggacaagcaaaatttgccgaaaaaactaattcttctgctttcggattatccatttctgccacaattgcagtgccacctgaaagctctaatgcggtttcaaaagactctgctaaacgtgttgctaaatctgaccgcactttaaaacgatcaaccactacttcaatagtatgttttttctgtaaggctaattttggcggatcagataaatcgcaaatttcgccatcaatacgcgcacgaatataaccttgcgcagcaatattttctaaaatcttaacgtgttcaccttttcgatttttgacaactggcgcaagtaacatcatcttgctgtcttctggcaaacttaatactttatccaccatttgactaattgtttgtgccgttaatggaacattatgatcgggacaacgtggctcccctactcgtgcaaacaataaacgtaaataatcataaatttccgtaattgttcccaccgtagaacgtggattgtgtgaggtagatttttgttcaatcgaaattgcaggggaaagtccctcaatagaatccacatcaggcttttccattaaagataaaaactggcgtgcatacgccgaaagagattcaacatagcggcgttgcccttccgcataaagtgtatcaaaggctaaagaggattttcccgaacctgaaagcccagtaatcaccacaagtttattgcgtggaatagttaaattaatatttttcaggttatgggttctagccccgcgaatatcgatattttccataaaataactcaaaagtatgaaataaatgtaaattttgcgatcattatcgcatattttaatatctgtgcaaatatccagttaaaatatatagatcttttaaaaaatttcaggcaaaataaccgcacttttttagataaaaaatgaggtttttttatggctggaattaataaagtcattattgtaggtcatttaggtaatgatcctgaaattcgtactatgccaaacggcgatgccgttgcaaatatcagcgtagcaaccagtgaaagctggaacgatcgtaatactggcgaacgccgtgaagtaacagaatggcaccgcattgtattctatcgtcgtcaagcagagatttgcggcgaatatttacgcaaaggctctcaagtgtatgtggaggggcgtttaaaaacgcgtaaatggcaagatcaaaacggtcaagatcgttacaccacagaaattcaaggcgatgtaatgcaaatgcttggtggacgtaatcaaaacgcaggtggttatggtaatgatatgggcggtgcgccacaatcttcttaccaagctcgtcaaactaacaatggtaatagttatcaatcatctcgcccagctccacaacaagctgcaccacaggctgagccaccaatggatggatttgatgacgatattccgttctaaattacatagattgaaaagtaaatgataaaaatcaaagagaagctgaataaaagagagcttctctttttattttactaattaaaaggactaaacctatgattatagatttagtccttaattttatagctttagttttagggaagattaattgctaccatttatcttccatatcacattttattgaagagtaaaactaatttgcacacttaaactcgaaggaaatcctgcgggtcttgttccaacagagcgagatacgttaatagcgtctaatgccgccttatctaaactttcatcgcctgaggattttgtaaccttagcaccacttaacgaaccatcagctcctacattaaaagatacactcacttttccttgtttgcgcattatcttcgctcgagttggataacgtttatggctttcaatttcacggcggattgcagaacggtaagccgctatttcactcgtatccgttccacttcctgctacctgtgcattgctattagctgcgcttgtngtacttgctttatcatttacgttggcacttgaatcaatattttcatcgccttttggtagctctttattgattggtttcttttgtggtttaacctcttttttaggtttattcttcggctttccttttggttttcctttgggttttggcttttccttttctggttctttgatttttttcggttcaggttttattgttggatcttctacaatttcttgtttttctggttctggctctttttgtacatttcctggctctggctctggctctggctctttttgtacatcttctggctctggagcaggttcttccaacaccatgccctgtaatagctccatagaaatacttgtagatatatcgccttgtgcactatttgcgctatcacttggctcattccaattccataagataaatcctataacaataccgtgtgcgatcaaagaaataagcaaacccaatagcgaacgttttgtttgctgcataattattccttacggcgtagttggtacagattgggaaggagtagattcttgagaatttttacccgcactttttcccttatctttcatagaaacaattgccacatttttgatttcatttttagaaagcatatctgtaatcgtcacaaaatcttggaaagaggcttcggcatcaatttttaaagttactttctgatctttattccattgagcaatttctgcctctagagcttcttgagaaataggtttatcattaaaatagagttgtttatccgctgtcactgtcaataatttagctagctcgtcagatttaaatgcgaccgctgtactagcttttggtacatttacttgaattttaccttgagagataaaagatgcagtaataagcaccacagtaagtagcaccaacataatatcaatgaaagggataatgttgatttcatcgaattttttcacgaattattccttatctttttgttcgcttaatactttccattttaaacgattaacttcaactttacgccccaaaccgttataaaacaccatagagggaatagccactagaatacctaatgcagttgcttttaatgctaaagataagtgcagcataattacacttggatcaatgtcgccaccgccgtgaccgatttgatagaaagttaataaaatcccgataactgtaccaagtaatccaacataaggtgcgtttgcaccgatggtagaaatcactgtcatattacggtttaaatcaatatctaatgcgtgaatagtagaataatgtgccacgcttacctttcttaaaaaaagataacgttcaattaccatcgcaagcataataatgctcatcagtaataataaaccgatgataaaataatcactgtactgctgtaaaaaatcaaaaagttgtaccattttttttccttgttatttgagaaatttctttgagaatataattgagaatgaatttcaatcatacgggggattttagcaaaggctaaataatgcgtaaaccttgaattgaaaaatttctgaattttttaccgcactttatgtggaaaagtgcggttattttttgaaatattatagggaacgaagataatcaatgatcatttgatgatggtcttttatcttaaatttatcaaatacttgcataatagttccgctttcattgattaaaaaactaattcgatgaataccgtcgtaagttctccccataaattttttttcgccccatacgccaaattgctccgcaacttgatgatcaggatcagaaagcaatgtgaaattaagttcttttttctcaataaattgagctaattttttcggggcatcaggactaataccaagtacaactaaacctagtacatctaattcggatttactgtcgcgcaatccgcaggcttgtgtggtacagcctggagtgagagcctttggataaaaataaattaaaacttttttaccacgaaaatcacttaaagaaacaaatttttcttgttgatttaataaggtaaaagcaggtgcttgattaccaacagataatggattcataaaaaactcctttaatgaaaaaaaatttgcaaattaacgttattttagcgactataacaagtgaaaccaaataataaaattaaaaaccgacggaggttatatgtcagcgcaaaattctttattttcgggtagcatagttgcccttgttacgccaatgaatcattatggcgaagtcgatttttcctgtttagaaaaattagtagaacaccacattgaagctggttctaacgcacttgtttctgtgggtacaacgggagaatccgccacgctaagtattgaagaaaatgtaaaagtcattgaaaagactgttgaatttgccaaaggacgtattcctattattgcgggagcgggtgcaaatgcgacgagtgaagcaattacaatgaccaaattattacgagacagtggtgtagcaggatgtttatctgttgtgccttattataataaaccaacccaagagggaatgtatcaacattttaaagccattgcggaatgtactgatttaccacagattctttataatgttcctagtcgcacaggcagtgatatgaaacctgaaacagttgctcgtttagctgaaattgaaaatattgtaggcattaaggaagcaacgagagatgttagccgaatagttaaaattaagcagcttgcaggtaagaattttattgttttaagtggtgatgatgcaacaggcttagaagcaataaaattaggtgctgaaggagtaatatcagtaacaaataacattgcagcaaaagatatggctgatatgtgccgttatgcacttgcgggagattttgataaagcggaagaaattaatgctcgtttaatgcgtttacatcacgacctattcattgaatctaatccaattccagtgaagtgggcagcttatcgcttaggcttaattaaatcgccacatttacgcttgccacttacaacacttagtgaagaaattcaaccaaaagtaggagatgcgctwaaaatcgcaggattattataaaaataaaggggtaagtaattacccctcacttttatgtattatagatcagtaaaatgatcaaaaagtgcggtcagaatttatcaaattttcaatttagttaaggttaatatatgaaaaaaataatattgaatttagtaacggctattattctagctggttgttcgtctaatcctgaaaccttaaaagcaaccaacgactcatttcaaaaatctgagacgagcattccccatttttcccctttggctactggaggggtacagttaccaaaagctgatgattcctattcattacctaatattgaagtgaaaaaaggggaagatattgatattcgcccaccattaatccctctcgctattattcaaaattcaataacaaaatttgatggcgaacgctcgttgattgtctatccaaaacaacaggcaaaactatataatcttcagcaagttgagcgtttattgaaagaagagggtatttcatcaacaacagatggttcgattttaacgactgattgggcaaaaacagaacgaattggcgataaatctatagaaataaaatatcaaatagaacaagttatgacagctgatgtaagtgcgcttaccgtatctattttacatatgcgccgagatggtattatttttacaccaaatgtatcagataaacaatattatacttcggaacgtttaaatcgcattgttttaacactcactaccgcatataacaaacaattacgggatttatcaagcactttaattcaatagggcgtcatataataatttctctaaaataataaatgtttaaaaatgagacatagatcatccttttgaaaattactctgatatttatctttaaaacacttgaaaatctaaaataagaacactattttgttattaactagaatttaaatcacgcaacaaagaggtaaatgctatgacacttaatattaccagtaaacaaatggacatcactcctgcaattcgtgaacacttggaggaacgcacttgcgaagttaggtaagtggcaaacgcagttaattagcccacattttgttttaaacaaagtacctaatggatttagtgtcgaagcctctattggcacacccttaggcaatttattagccagtgcaacttcagatgatatgtataaagcaattaatgaagtggaagaaaaattagaacgtcagcttaataaacttcaacataaaagtgaatctcgccgagctgatgaacgtttaaaagattcttttgaaaactaaatactgtagataaaatctaatctggcagtcttattgtaaaataatatgtctgtcagattaattttagatgaaacaattaaatcactaaaaattgatgatattaactcaaaatattaataaattttattaaatatagattaatttaacctatcctgcacggcgatgtaaacttcagtacattcacgcttatccactacaagaacataaacgacaactttatcttcaataacttcataaacttaaacaatgccctaagagcgaaattttattttataaaacacaccaaaaaatctaaaaaaccgatcggcaaatacgtatgantttcctaagcgtttgattaattttttcttaaattgcttttaataaaaatagagactaatgaaagatacagattaaatttatattttttaacgaaatagatattatttgacgggattaatggcggtgagaaagggatttgaacccttgatgcagtttcccacatacacgctttccaggcgtgctccttcaaccactcggacatctcaccgtaaaaggtgagcaaactataaagatttactctggtttagtcaagttttttactctaaaaaataaaaatctttaaaagattagttaaaaaataggcaataaaagctattgagctaattcagagttagaagatactaataatttagtaagatgtaaccttgataattattaaaacagttgattttaatagataccatatattaattatcttttattctctttcttaatctttttattttaattaaaaaagggattttctcaaaatgatcataccaagatgatggtatatcaataattttatccatttcttttaaaagtaaatttcctatatgacaatttaagtgactgcattttttgtgccaaaatttatttggaccacaataatgagaaataactattggcatttttacgcataataaattttctttttaatcaaatctcgatccgttggtgtaaaattaaatctattattaataaattttacttttcctttacagataccatttagaatatcttgatcttggtatttcataacattattgtatttatcatccaatttattgatttttggaaaatattttcttctttccatttatttaaattaattaataatatgcccgcattaaaataagaatatccttctaaaccaattgtttttttataagcttcattttttacatcaataaaagtatctcgacatgctgccaaataatagttcgttatatctatattccaaagttcttgaagtgaagagtttgttaatgtgtccacatcaatataaatagctttttctatattctttatgtatttagttaaatttagtctagcgtaagtagccaaagatatataatctattgtttttggaaagttttgaaaatctgactcacaaacgggcaagaaaaatactttacaagaatatgcgcttgctaaattatttattatggtcttattttcctgatttattttcatatcaagantataaaaatttatttttttaggtgtatttttaataatactaaaaatacttacagctaaataaggggcataatagtggtcagacgaaaatataatattcattgtctgactgacagtccgtccgtctgtctgtctgtctgtctgtctgtctgtctgtctgtctgtctgtctgtctgtctgtctgtctgtctgtctgtctgtctgtctgtctgtcatgaaattatctctgattaacgtgtgaattattattttttgggttatttttttgatagattaaataattttatttactttataatttactttttaaaacactcaatgcctttgctcgatgagaaatttttttcttctcagctgtttctaattcagcaaatgtgcaaccttgttctggactaaagaataaactgtcataaccaaagccattttcgcctttttcttcaaaaccaatcacgccacaacactcaccttcggcgataattggcgatggatccgttggatgctgtaaaaacacgatacagctcacaaatttggcttggcgttgttcttgtgcaatatgagcaagctctgccaataatttctcacggtttttagcatcattgccctcttcaccagcataacgggcagaatacagacctggtgcgccattaagtgcggaaactactaagccagaatcatctgcaatagcaggtaaacctgatttctctgaggcataacgggcttttaataaggcattctctacaaaagttaagcctgtctcttctgggctttcaatgcctaaatctgtttgtgcaatcacttcaaagccaaaatcagataggacatcagccatttcttttacttttcctttattgcctgtagcaagtacgattttttgtttcataattagtccttttattgatgataagctgacgttaaatcagcccagttttgctcggtaaattgaatattcattcgtccaacttctttttcgaaggaacgttttaaacggttcagattttgcactttccaaaaatctgcagatttttcgccgcacttatcaaaatccagtaaccaacatttttgcccttgttcagtttgttgaagcaaaatattatgtgcattcaagtctgtatggcaaatctgtaaatcatgtagttttcgaatcaaacgaccaatttgcatccaagtttcttttggcaatgtttgtgtttgtaaaagtgcggttaaatcctgcgcgttttcgattttttccgtcaaaatatccgcttgatagcaaatacctaacttgcctttttgaatacgtgcggcaatgggtttaggcacaggtaaccccgcttcatacaaacgttgcaacaaatgaaactcagcaaaactacgggtagtttcaagagcagaaaaacgataacgatctttgttcagtttaccccaaagtccgccgcgataataatgacgcaacgcacaatttacaccaaaccaatcttcagtttgcaaaaaataagtgatgcctcgaccttttgcacttcctatcactcgttcttgtttttgccaaaattccgcttggaaaaactcggttgcttgctcaaaagtgcggtcaaaattaaagataaaatattggttatcttgttggaattggtgcattggaacgttgttatgaatagaaaatggacttattctactttaaaataagcacaaattaaatgataaaggaacgtcaatgccactttttaccgaagctccaaaatccctttgtattctccgattgtcagcggtaggcgatgtctgtcatgccttagcggtggttcagcacattcaagaatattatccccaaacagaaatgacttggattgtaggaaaaaccgaaatgggtttgctttcaagtattcctaatatcacgcttattccttacgataaaaaaacaggatggaaaggcgttttatcactttggaaacaactaaaaaataaacagtttgatgcgctattaaatatgcaaacagcatttcgtgcatcaatcctttctttaggaattaaagcaaaattcaaaattggatttggagaaaaacgttctcgcgaagggcaatggctatttgtaaatcgtcgcatcagagatcctttttcccctcacgtattagatggatttatggctttcgctgaatatattggcgtgccgaaagcagaaccgaaatgggaattagctatctcacaagatgattataaatttgccgatcaatttattgatttctctcgtaaaaatttattaatttccccttgttctagcaaagcagaaaaagattggctaatcgaaggttatgcagaggttgccaatattgcccatcagcataatatcaatgtaatcttctgcagttcaccagccaaacgtgaattagaaatagtcgaaaaaattaccgcactttgccatttcacaccaaccaatattgcagggaaaacaaacctaaaacagcttaccgctttaatttctaaggttgatctagtactttcgccagattcaggccctgcccatatagcgacaacacaaggtacacccgttattggcttgtatgcctatcacaatcctttgcgtactgcaccttataataatttagataacgtggtatcagtatatgaagaaaatgcccaaaaagaatttggcaaaccgtcatctgaactaccttgggcaacgaaactaaaagggaaaaatttgatgacagagattcaagtggaacccgtcattggacaaatgaaaaaattggggttattttgaaaaaataatctgtatctcaaaacttagatggttttaatatagccaacttgaaagttgtttttggaaagtaaggactttagtttttttaagttaaaaatcaataacttgctgtcaaaataattatatttagtcataaaaatctataccttaatctctcgcttatttagtccaatttttgcaggtacagattgaaatccaaaattagtttgaattttacgcaattaaattcaaatgattataaataaaccaattgattattattattattattattattattatcgccattctcctctttttaattattacaataaggaaaacagatgcgattttctaaactttcccttgcaattacaacaaccttagtgacagcaaatgcgctagcgcaatccgttgaattagactctatcaacgttattgcgacacgagayccaagtaggtttgcttatacgccagaaaaacaatctaaagatagtcttctttctaagcaagcgactagtgttgcagatgcgttagaagacattcccaatgttgatgttagaggcggttcgagaagcattgctcaaaaacctaatattcgagggttaagtgataatcgtgttgtgcaagtcattgatggcgtgagacaaaattttgatttagcacatagaggttcttattttcttccaatgtcactcatccaagaaattgaagtaatcaaaggaccaagtagctccttatggggtagcggtgcattgggtggtgttgtggcaatgcgtacgccaaatgctttagacttattgaaaaataatgacaaattcggagttaaaattcgccaaggttatcaaactgctaataatttatcggaaaaggatgtttctgtatttgcggcaaatgacaaattcgatgttcttattagtggtttctataataatgcggataatttacgcactggtaaaggcaacaagctaaataataccgcctataaacagtttgggggcttagcaaaattcggttggcaaattaatgatgcgaaccgcgtggaattatcccaccgcgaaactcgttttaaacaaacagcaccaagcaataatgaggtggaaaacgaacttactaatgaacaaattacagatcaaatcaaaaagttccacggacaaaaagacgatcttcttcctcctacaacacaaccatcaccatcagaaagatcagagttttactctaaagtgaaaacacgtttaggtagtgtcagttatttaactgatcaacaaattcctgatcaaagcacggtatttaactattatttaacgccagataatccttatctaaatacgcatatcgcactgtataacaataaaactattgagaaagaacagcgtaaagtcagtggtgtgaaagatcagactaaattgactacccgaggtataaatttacgtaattcttccgaattatctcacatttcctttgtttatggggtggattatatgcgagataaaatccgtaccgaacgaggcacaaacggtagcgatgcgaagtttcgagcggacccctataatgcgaattcaaacactacaggcgtttatttaatcgcccatattccgctatttggggaaaaattgctagtttcgccaagtgtacgttatgaccactacgatacctcaagtaaaaccgtaaaatacaaggataatcatttatctcctgccacaaaattaacttggatagtgaccaattggttagattttactgccaaatataatgaagctttccgagcaccatctatgcaagagcgatttgtgagtggtgctcactttggggcaaatactctagggctagatcacatcaatagatttgtagcaaatccaaatttgcgccctgaaacagcgaaaaataaagaaattaccgcaaatctacattttgatagtctgtttaaacaaggcgataaattcaaaattgaagcgacttatttccgtaatgatgtgaaagattttattaacttaaaaatatttaatgatgcaaagacaagtgcaagtgcaggtgcaaatccaaatacaaatggagcattgttgccaaaaaattcccagtatcaaaacataactaatgcccgtttaagcggtattgaattgcaagctcaataccaaacagaacgtttaacgctatttactaactatggcagcaccaaaggtaaagataaagatagtggcgaagctttatcaaacattgccgcaagcaaaatcggcgtaggggtaaattatgctttagtaaaagacaaattcacggtgggagcgacagtaacccattacgctgctcaacgccgagtgcctaaagatcatagtgttacctacccaagttatatactgaccgatcttcgtgctacctatgcaccattaaaaggcgaatggaaaaacctgcgtttagattttgcactggaaaacttgtttgatagaaaatatcaacccgcgtttagtttaatggaaggcactggtcgtaatgcgaaaattagtgcggtttatagcttctaaatttactttggaaaacgccctaaagctgttttccctcaatttttgtaattttatcaattaataggacataaggaatgaaaatgagacctcgttattctgttattgcaagtgcggtcagtttaggctttgttttgagtaaatcagtgatggcattagatcggccagatactggatcattgaaccgtgaactagaacaacgtcaaattcaatcagaagccaaacctagtggcgaattatttaatcaaacggcaaattcgccttatactgcacagtataaacaaggactgaaatttccacttaagcaagtacagattttagatcgaaacaatcaggaagtcgtcacagacgagcttgcacatattttaaaaaattatgtaggaaaagaggtatcgctgtcagatttaagtaatttagcaaatgagatcagcgaattttatcgtcataataattatttagtggcaaaagcaattttaccaccgcaggaaattgagcaaggtacggtaaaaattttgttacttaaaggtaatgtaggcgaaatacgcttgcaaaatcacagtgcattaagcaataaatttgtatcccgtctctctaatacaacagtgaatgcgtccgaatttattttgaaagatgagttagaaaaatttgctttaacaataaacgatgttccaggggtaaatgctggtttgcaactctccgcaggcaaaaaagtcggcgaagcgaatttactgattaaaattaacgatgcaaaacgtttttctagttatgtttcagtagataaccaaggcaacaaatatacagggcgttaccgtttggctgcggggacaaaagtcagtaatttgaatggctggggcgatgaattgaaactggatttaatgagttctaatcaggctaatttaaaaaatgctcgtatagattattcctctttaattgatggttattctacgcgttttggtgtaactgctaactatctcgactacaaattaggtggtaattttaaatcattacaatctcaagggcattcccataccttaggggcttatttgttgcacccaacaatccgtacaccaaattttcgtttaagtactaaagtgagctttaatcatcaaaaccttacggataaacaacaagcggtttatgtgaaacaaaaacggaaaataaatagtttaactgcagggattgacggttcttggaatcttattaaagatgggacaacttatttttcattatctaccttgttcggtaatttagcgaatcaaactagtgaaaaaaaacagtatacaaaagaggattttcaaccacaatcgcattttacggtatataactaccgcttgtctcacgagcaaattttaccaaaatcttttgctttcaatattggtataaacggtcagtttgccgataaaacccttgaaagctcacagaaaatgttgcttggtggtttgtctggagtacgtggacatcaagctggtgcggcttctgtggatgaaggacatttgatacaaacagaattcaaacattatttaccagtcttttcccaaagtgtgctagttagttcattgttctatgactatggtttgggaaaatattataaaaatagccaatttctcgaaaaaggcgtgaaaaatagcgtgaaattacaaagcgttggtgcaggactttctctttcagatgctggcagctatgccatcaatgtcagtgtcgccaaaccgcttgataacaatattaataatgccgataaacaccaattttggctttctatgattaaaactttctaaggaggtatgcaatgtataaattaaatgtaatttctcttatcattttgaccacttacactggtgcgacatatgcctctgcacgggatttgccacaaggtagcagtgtagttgttggggaggcaaatgtttctacaattggaaataaaatgacgattgatcaaaaaaccccaacaactcaaatagactggcatagttttgacatcggtcaaaataaagaagtggaatttaaacagcctgacgcaaattctgtggcatataaccgtgtaactggcggcaatgctagtcaaatccaagggaaattgacggcaaacggtaaagtttatttagcaaaccctaatggggttattattacccaaggggcagaaattaatgtagctggtttatttgcaacaaccaaagatttagagagaatcagtgaaaatggcaatggcaatggcaataaatttacccgtaaactaaaagacggtcaggtggtaaaagaaggtcaagttatcaataaagggaaaattaaggcgaaagatttcgtggtacttaatggcgataaagttatcaatgaaggggaaattgacgctacaaacaatggcaaagtatatttatcctcaggctataattttacatttaccttatcagatagcngcataagtgtggcattagaagataatgcagtacagagtattgttcaaaatgaagggattattaaagcaggggacattacgctaaatgcaaaagggcgtaatcaagcattagatagcttggttatgaataatggtgtgttagaagcaactaaggttagtaataaaaacggcaaggttgtgttatctgctgacgatgttcagttgaataataaaagtgatattaaaggggagagtgaggttgtatttactaacgaacctaaaaacaagataaaaatcacttctcaaactggctcaaaagttacctcgcctaaaatcaactttacaggcaaaagcgttaatatcaatggtgactttggacgtgacgatagtaaagcgcactataacgaagagcataaaagattagatacagaagttaatattgacgtgccagacaatgaaaatattcgtattgcggagaaagataatacgggcacgggtacgggtacggattcatttatacaaacaggggcgttaagttcattactagctaataatggaaaagtgaatcttaaaggaaaggacgttaatatttcaggacgtattcatatagattcctttagaggctcagattcgctattaaagctaactaaccaaggtcatattaagatcaatcatgcggatattcattcaacaggtcgtttattttttataaccagtttgcagaatgagaaagattctcaatcagatattaccattactgacagcaaaataaatcttggtaacggagctatgggattggggcgtagtctcgataaagaaaactgcgataaccaaagatggtgtagaacggaaacctcacaacgcaagaagtttgatgttcatatgcgtaatgtagtatttgatcaggttgatgatgtggttgtagcaggtggatttaaaaaagttaatttagataacatcgttgccacaggaaaaacgaatttttacattgatgggggggtatcccgtaataattcaagatatgaatacggtgtgttagatttagacaaacgtacgctgttatcggagttagatcaacgcagacgccgttggaaatattacaatgatttagatttagatatgaataaagcttattggcatcgttttgatatgtttgccactaaaaatacagggcgatcaactattaaagacacagaaattaatatttctaacagtaagattaatctgaaaaatggatttgtacatttactggcagaaaaaattaaattagataatagcaagattgatattacttttgataaagataattcacaagatatttcaactcaaattaaccgtttaggaatgaatggtaaagtgtcaatggtaaactcacatattaaaatcgtgggcgatgagaaaagcgatatatctgcaaaagcaccttatgctacgatgtttttaatcggggaattaataggggaaaaaagttctatttttgtgaaatctcatcagggttacacctttagaactgatggtgatacaaaaattgcaggtaaaaacagtaaagatgacttgaaaattaccgcaattaacactggaggaagaactgggaaagaagtgatcattaatggtgcgcctggctcaattgataatgatgcgaatattgccaatatggcatttactattggtgataacgcaaataccaaaacaaccattgaaaatgccgacatcactgccttagcaccaaacggtgggacagcttatttaagctccaaaggggtagaaattgaggtaaacccaaattcaaatttcacattctttgaacttcctcgtgagaaaaactttaatcaaacaaaaattaaaggcgattctaccaaactcagtgaacgtggttttgctagactttatgacaaaattaacggtgtgcgagccagcaacttgtctgctgagcaattgaatgtgacggacgcaagcgaaaaaatcattaatacaaagttagtgagtagcttagatgttgaaaaacttgtttctgttgcagtttgtgatgcaggtaaaggttgcgaagaacaacaattcggcgataaaggtaataatactaaagtgagtgttggagagttagaaactgaacaataactattcagaacacaaggtaaaagcataaagccaatctgacagacatcaattaaattgcatgcctgtcagatttattaatagccactatcgctacattattttaaacaaccacgaacaatcaatacgccaacatttcgagcttgagcgacggcttttggtttactcagtttaatttttaatccttgaagttgataacgtgactcaagcaaatccgccacttcataagccactcgctcaatcagcaagaaaggtttgctttccacataatcaataatcgcttgactcacttcagcataatttaaacaatatacaacatcatccgtttctgccgcttgtttgcaatcccaagccatttccaaatcaaacacaagtttttgctttatttgctgttcccaatcatatacaccgatttgtgcaaaaacagtcaattcttcaataaaaacacgatccataaggtttcctctaaaattattgtaggcgtatgctatcaattttgggtagaataacgaacagtttttcttgctggagtgcaaaatgagccttttcgcccttttttatatgctttttgcctatcttttaggctcaatttccagtgcgattttaatttgtcgcattgcaggcttgccagatcctcgtcaaaatggttcacacaaccctggggcgacaaatgtgttgcgcattggaaatcgtaagtctgccttggcggtgcttatttttgatatgttaaaagggatgattcctgtatgggcagggtattatttaggtttaacccaatttgaattgggaatggtcgcacttggtgcttgtttagggcatattttcccaattttctttcaatttaaaggtggcaaaggtgttgcaactgcctttggggcaatcgcaccgatttcttgggctgttgcaggttcaatgtttggtacgtggatctttgtttttcttgttagtggctattcttcattaagtgcagttatttctgcattacttgtgcctttttatgtgtggtggtttaaacctgaatttacttttcctgttgcactggtatgttgcctattaatttatcgtcatcacgataacattcaacgcttatggcgtggtcaagaagataaagtttgggctaaatttaaaaagaaataaaaattttaccgcacttttctaaatttccactggagtttcctgtgtatactaaaggttccgtttccactcgtattgcgaaatatttatttatcattcttatcgttgctggtgtgattagttctctcagtttggcaattatgagcagtaataaatatgatgccgaagccattaatatttcaggttctttgcgtatgcaaagttatcgcttactttatgaaatgcaagaacaaccagaaagcgtggaaacgaacttacgccgttatcatataagccttcattcatctgctttactagaagttcaaaatcaatttttcacaccgaatgtattaaaacattcctatcaaaacattttgcaacgttggacgaacatggaaaaatatgcgcgccaacaggatgtaaaaaactatagtaagcagcttactgactatgtggcagatgttgattattttgtgtttgaattacaacgttttagcgagcagaaatggattttaggcgtttcagtattaggttttgcgatgttgttaattttgctgatggtgtcttatgtgatttggtatacaaaccgagaagttgtgaaacctttgcatttaatgacaaaagccagtatgcaagtgcaaatgcgtcaattcaatcatattccacttgacacaaggaaacaaaatgaacttggcacactggctcgcgtatttacacaaatgtccacagaactgggacagctttattcgcgtttagaagaagcggtaaacgaaaaaacgcaaaagttgcgtcaaactaaccgcactttaagcactctttatcaaagtgctcaacttctgaatacaaacacaattaacgataaaattttaaatcaagttttaaattacatttttattagcgaccatttgaacttcgttaaagtggaagtgatgggggctgaacattgggatattacattgggtaagcaagatgctaataatgaactacaaatcgaaaccctttctgtggataacgaagaattaggtgtactctcttggcaagcaggattaccttgtccagatccccgaattatgcaaaatttagcgcaaatgcttgctcgtgcgctttatttccataaaaatttacgtcagaaagaacagcttttattaatggaagaacgctcaattattgcgcgagagttgcacgattctttggctcaagtcttatcatttttacaaattcaacttactttgctcaaacataatctgaagaaagaagacgaacaatcaaaagaaaagagtttggcaattattgccaattttgaacaagccctttctggtggttatgcacagttacgtgagcttttagccactttccgtttaaccatacaagaagcgaatttacagcttgcactaaaacaagtgattgattcattacgctcgcaaacaacaatgcaaatgaatgtgaattgtcaattaccatcgcaaagtttgaaccctcaacagctggttcacgttctgcaaattgtacgtgaagccaccaccaatgcgatcaagcattctcaaggcacggtaattgaaattagcgcaagaattaatgcggaaggcgagtatgaaattttagttgaagatgatggggttggcattccaaaccttgaagaacctgaagggcattacggcttgaatattatggcggaacgttgtcgtcagcttaatgcacaattgcatattcatcgccgtgaacaaggcggcacacaagtcaaaattaccttgccacatacattatattaggacatcaaaatgcaaaatttacaaccttttcacactttccacattcagtctaatgctcgtgaaattattgaagcacatagtatcgaacagctacaacaagtgtgggcgaattctaaatcagaaaatttacccactctttttttaggtcaaggaagtaatgttctatttctagatgattttaatggcatcgtgatccttaatcgtttaatggggattacgcacgaacaagatgcaaattttcactatcttcacgtcaatggcggggaaaattggcataaattggtggagtggtctattaataatggtatttatggcttagaaaatctggctctgattcccggttgtgcaggctctgcccccattcaaaatatcggtgcttatggcgttgaatttaaagatgtatgtgattatgtggaggtacttaatttaaatacgaacgaaacctttagactcgacacagaacaatgtgaatttggttatcgtgagagtatttttaaacatcgttatcagcaaggttatgtgattacagcggttggattaaagctaaaaaaagattggcagcctattctaaaatatggttcgcttgtagagttcgatccgaaaacggtcaccgctaaacaaatttttgatgaagtctgtcatatccgtcaaagcaaattacctgacccaaatgaagtgggtaatgcagggagtttctttaaaaatcccgttgtcagttcagaacattttgaagaaatcaaaaaacatcacgaaaatctaccgcactttccacaggcagatggctcagtgaaattagcggcaggctggctgattgatcaatgcaatcttaaaggttttcaaattggtggggctgcggttcataaaaaacaagcattagtattaattaacaaaaacggggcaacagggcaagacgtggtcaaactcgcccatcacgttcgccaaactgttgcagraaaatttggtgtatatttacaacctgaagtacgatttatcagtgcaactggcgaagtaaatagtgagcaaattatcacgtaattttataataattgaactttcaattgataaaatctgtcttattaacaaattggttcaataagatagcttattgtgctataactaggtacattgattggcaaaagccaaaataaagaagggaaacgatggataaagaaacacaaatgatgttagttcctcaaggcagtatcgaaggttatattcgtgcagcaaatgaatatccgatgctgaccgcagaggaagaaaaggaattggcagaacgtttgtattatcacgaggatttagatgcagcgaaaaaactcattttgtcgcatcttcgtttcgtgatccacgtggcgcgtggctattctggctatggtttgccacaagctgacttaatccaagagggcaatatcggtttaatgaaagcggtcaaacgttttaaccctgaagttggtgtacgcttggtgtcattcgctgtgcattggattaaagctgagatccacgaatatgttcttcgtaactggcgtatcgtaaaagtcgcaaccacgaaagctcaacgtaaattatttttcaacttacgtaaaactaaacaacgtttaggttggttcaatgaaaatgaagttgatatggtcgcaaatgaattgggtgtttccaaagaagatgtgatcgaaatggaatctcgaatgagcggtgcggatgtcggttttgatttacccactgatgatgcagaaacagagacctattctccagccctttatttggaagataaaagttctaatttcgcagcagagctggaaaatgaaaactttgaaagccaagcaaccgagcaattaggtgcggcgttacaaagtctagatgcacgtagtcaggatattatcaaagctcgttggttagatgataacaaagccacattgcacgacttggcagcaaaatataatgtctctgcggaacgtattcgtcaattagaaactaatgcactgaaaaaattaaaaagtgcggtgaatttttaaataatttagaaaaagaaaacctgctgattagcaggttttttatttctcatttaaccgtaatttcaaatcttcagcagtttggcaagtcttaatcttatcaaacacttggttcgcttcattatattccttattcaaataacgtaaccattgtttaattcgtgccacatgntaaaaaccgctgtcatattcattttcgacattcgcatatttttgcaagattttttgaatctcataccaaggcattttttctgcatttgatttcagaacatgacttaaattcggaatattcaacgcgcctcgtccgaccattaaatcctgacaacctgtttgggataagcaatcttgcccatcttgccaatgccaaatttctccgttagcaataactggaatggataaacgctctcggacttcgctaatttttttccaattaattcgatcagcacgataaccatcagcttttgtacgtccatgaactgtaatttcggttgcgccgccttgctctaccgcatcagcgatttcaaaggcttgagaaatatcatcccaacctaaccgcacttttacactaacgggaaattcacttggcacggctctgcgtaaggcttgagtggcacgataaatcaattcaggctgtttcaataatgccgcaccaccattgctgccattcactgttttagaagggcaaccacaatttaaatcaatgccatgagaaccaagatcgatcgcacgaattgcattttcagcaaggcattttggatgctgccctagcaactgsactcgcacaggcgtgccagaagaagtaaagccctgattttttaattcagggcataaacgataaaatactttttcagggagaagttgatcaactacgcgaacaaattctgttatacataaatcgtagtcattcacttcggtgagaagttcacgtacaaagggatctaaaaccccttgcataggcgcaagaataacacgcactatttccagccttttgctttacaaattaaatcgtaagcggcttgaatctgttgagttttttcttttgccatttccatcatttctggcggtaaacctttcgccacaagtttatctggatgatgttcattcattaaacgacgataagcacgcttaaccgtgctttgctcgtcggactcagtcacacccaatactttataggcatcatttaaagttgggcctgaagcatgttggtaaccaccactattttgttgttgatattggtagccaccttgataggcaccttgttgatatttctgataaaaaccgccttgagtaaaagctcgagcagccatttccatcgcaatcatttgttcaaattgcatacgagaaagaccaagttcttcagcgatcacataaagcacttctttctcattttcgtgaagttctgaatcggcaaaagctgcttgaacttgcacttgtaagaacattctcaataaatcagcacgttgcccacaaccaatgcgaaattcacggataacttgacgaatcgggaaatcagattctttaccacgacgaaacgcatcttgcgctaatttacgcccagcatcatccagtttaagstgaatcattaattgattagctaattggatatcttcttctgttacacgccctttcgatttgcttaaatgccctaacaccgcaaaggaggtttgcataaacaagtcttgacgcgttgttttctttttaaagaaactagnacttaccgagccaagntcatacaattttttatctgcaatagagcctaaaatgagaccagcaatcgcaccaaaaaatccaccaactttccaacctaaaaatacgcctataatttttccaataaattccattctttcctctgttaagtcaaagtgcggttatttttataatgttatttataatgatgataaaaatttatttctcaagttttatacgccaaattcggcacgataagcacgcatttctggcaaatggctactgtatcgaggatcttgttcgataaattgcatcaaatcatctaaatcaatgattgatagcacttggcattgataatcacgttctacttcttgaattgctgaaagctcgccttttcctcgttccttacggtttagagcgatcaataccgccgcaagttctgcctgatttgcactgattaattccatagattcacgaattgcagtgccagccgtaatcacgtcatccacaagcaaaatttttccttgcaatgggctaccaattaaattgccgccttctccgtgatctttcacttctttgcgattaaaacacacgggtttatcaataccataacgattaaataacgccaccgaaactgacgtgccaattggaatacctttgtaagcagggccaaaaaccacatcaaaatctaccgcacttgcttgaattgccgcagcataaaactcgcctaaacgcgctaaatctgcccccgtattgaacaaacctgcattgaagaaatacggacttttacgccccgatttcaaagtaaactcgccgaatttcaatacatttcggcttaaagcaaattcgataaaatcgcgtttatattgttccattttttaactcctataaactgtgtttataagcctaacgcttcgcgttgagcgataaaaatttgattacagccttgtttcgctaaatctaataatgttaataattcttcatggctaaatggctcgccttctgcagtgccttgcacctcaatcatgcgaccatcttccatcatcacaacattcatatcggtttccgctgcagaatcttccacatattccaaatcacaaacagcttgaccatcaacaatccctacagaaattgccgaaactagccctttaatggggttagtttttaacgtgccattctcaattaaaccattgatcgcatcacataatgcgactgcagcaccagtaatggatgcagttcgtgtgccgccgtccgcttgaataacatcacaatctaaagtaatcgcacgttcacccagtgctttaagatccaccatggcgcgcaaagagcgggcaattaagcgttgaatttccattgtgcgtccgccttgtttacctttagccgcctcacgttgcatacgactatgtgttgaacgtggcaacattccatattcagccgttacccaaccttgcccttgtccttttaagaaacgtggcacagcatcttccactgttgcagtacaaagcactttggtgtccccaaattcaacaagcacagaaccttcagcatgcttggtgtagttacgggtaattttaatttggcggggttgattattttctcgattatttggacgcataattattccttgatatggtttcgaacgatgtaataaaaaagcgcactattctagcacgctttagtttttatttttgttaaaattcgctaagatattgattattgataataaaacagcaaggtgctttaccttgctttattaatttggtggagataatcgggatcgaaccgacgacctcttgaatgccattcaagcgctctcccaactgagctatatccccataaaagacagcgacatgataaaatttgactatgtggctgtcaatacgattttattatgtgtttgttatccgattaaatattaagcgttttgtgcatgaataaaatcaatagcacgctgaatacgcgcaagtacgcgatctctgccgataccgactagggtaacatccattgatggcgattgaccagaacctgtcaccgcgacacgtaatggcatgccaactttacccatgcccacttctagttcagcagctgtttgctcaatggcttcgtgaatagaatgtaaatcccagctagaaagtgcggttaatttttctttcacttttgcaagcgcttcagcagcattgcctttgaaatgttttttcgctgcggcttcatcaaaggtttcaaactcttcaaagaagtagcggcttgaccttgccatttcttttaaggttttgcaacgttccgcaagcatggtgactatttcagttaatgcagggccattgcttgtatcaatgccttgatctttgtaatgccattcaaggtgtttagccacatattctggcggtaattcacggatataatgttgattcaaccattgtaatttttcggtattaaatgcgctagctgatttgctaacatgatctaattcgaaatagttgatcatttcttcgcgactaaaaatttcttggtcgccatgtccccagcctaaacgaacaagatagttaattaaagcttctggtaagtaaccatcatcacgatattgcattacgcttactgcgccatgtcgtttagagagtttttgaccatcatcgccattaatcatagaaacgtgtgcataggttggaattggggcaccaatcgcttttaaaatgttaatttgacgaggcgtgttgttgatatgatcttccccacgcacaacatgtgtgatacccatgtcccagtcatctacaactacacagaagttataagttggagaaccgtctgtgcggcgaataataagatcatcaagctcactgttgctgatttcaatacggccacgtacggcatcatcaaataccaccgagccttcagttggatttttaaaacgtacaacgtggggttcatcaggtgaatggttgtgatcgtgtaagcagtgacggtcataacgtggtttttctttattttgttcttgagtatgacgaagttcttctaagtgttctttagtacaataacaacgatatgctaggccttgttcaatcatttcatcgatcacttggttataacgatcaaagcgtttagtttggtaataagggccatgctcccacggaagatttaaccattccatgccttcaataatggcagcagtggcttcaggtgttgaacgctctaaatcagtgtcttcaattcgtaatacaaattcgccgttattatgttttgcgtataaccaagaataaagtgcggtacgtgcgccacctacatgtaaataacctgtagggctaggagcaaaacgagtacgcacttttacatttggatctaaattaaaaggagcatctagtttcatttttataacctatcttcaataaaatattagtcgttattctactacgacttgtttgacttctaaataaaaaagcggattttatgcttatttttacgacaattaaacaaaatttaataaaaaggtattgactgaaaatgcattctccctataatgccaacccacaacattaagggcgattagctcagttgggagagcacctcccttacaaggagggggtcactggttcgagaccggtatcgcccaccacttctctaaaaagttttcttaattttactaagtttgaccaagcgggcgattagctcagttgggagagcacctcccttacaaggagggggtcactggttcgagaccggtatcgcccaccacttttctaaagtgtcctttccgctcaaactttccctttatatttaaacgctttctagtgggcgattagctcagttgggagagcacctcccttacaaggagggggtcactggttcgagaccggtatcgcccaccacttaaaagtgtttaaataaaccgaaaatttagggttttgccttaatattatcgggcgattagctcagttgggagagcacctcccttacaaggagggggtcactggttcgagaccggtatcgcccaccactttattttcaaattatccaaataatttccttttcccgttcaatctattacgtttacgtgataaagtgcgcaggcattgtcatatctaattttaaactgtttatatatcatagggaaaatttatgatcgcttatattttcttagctttattcacgattgcggcagtgatttttatcgtaaactcccattatcgttggacttatttctttgctattacgctttttacttttttatttggtggcatgcttatggtttccagccaatggcaacgtgctttaaatttttcatctgtgctttttgtggtactgatgttatttcaccgtttaaaaattcattattacaaacaacctttgttaatttcagatttctttcttgtggtagattggcgaaattgggaaaccttaattcattataaaggtgcattgtttggcgttattgggctactggcgttattaggttatgcgattttkggttttaatgatgtcgagtctttaggggtattgggtaacagcattggtgctttattgtttatcgttagctttagcttgatgtggcattattctaaaaatccaagtgcggtgcaagtttggttagattctttgcctgatgatggtcgtgatgtgtttttaaatttaccaatgtcttgtcgcggtatttttttcaaagtgccaaattttgatggcaatagccaaaattttattgaaaaaatgaccgcactttcatctgatgcaaacaacctatctgaaacaaaacccgatattgttgtaacattaatggaatccacgctgaaccctcatcaatttgcttttagtcagcaatctattccaccactttccatgtttgaaccccaaaatgatacagtatttgcttcgccgttgcgtgtacatacttttgctggcgcaacatggaaatcagaatttgcttttttagccggtgtgccttcaaccgattttggggcgttagcaagtggagttttttattctgttgtaccgcacttgcaatcaggtttagtgaaaaatctaaaagctcaaggatatttttgtgttgccttgtcgccttttacaaaaggtaattacaatgcaaaatccgcttatgatcatttcgggtttgatttgatgttacagccgcaagatcttggttatcctgcacctatcagtaaaaatctttgggatattagtagtgaagaaatgatgaaatacacccgaatgattttggaaaaacagcatccagcgttagaaaatgtagatcagccaatgtttgtttatgtattgactatgcgtgaacatggtccatacgaattaggcatggaaaatacatttaatcntcaaatgcctnatttaggagcnaaaagtanntctgcattgaatgactatactcaacgtattgttgcattgaatgatgcgattgaaggaataaataactatttacatgaacgtaaaaagccttttgttctaggttatttcggtgatcaccaagtggcatttgataatgcgatccctccgaagaaaggggattatgcacagcctgattatgtgacacaatttgttgtaagaagtaattgtgcaagtcaatttaagcaagaacaaaagtttttagatcttgcttttgctggaggtgttttgatgaatgtagctggattatcagcagaagatgaatttatgaaagcgaatatggcaatgtgtaaattgagtgatggcaaattagaagattcttctgatattcagctactcaataattatcgccattatttataccaaacattggcgattgccagataattttcttatngatcgagcattattgctcgatcngctcgccaatttcatccaaggttgaagctaattgcgcaccaactagcaccacaagccaacttatttgaatccacaataacataattggtaaagttgccattgcaccgtaaattaattgataagagggaaaagtgacgatataccaagtaaatgcttgtttaccaagagtgaaaaaaatcgcggcaagaaatgcaccgtaagctgaatgcttaattttcacttttttattcggtacaaccgtataaataagcgtaaaaataaaccaagtaaataaaaaaggcacaaaactgagcaattttaagcctaatgataaatgttccgattgctcaaacattattttaatatacgaactaatcccaatgctcacgccaataataagtgggccaagtgtcaaaatcatccaataaatcgcaaaagaagaaagcggagagcgagattgactattgtgccaaatactatttagtgttcggtcgatgttattaattagcatcaaggcaacggcaattaaactcacaattcccaccgcactcattttctttgagtttgatacaaattgatcgatatattcgcccaccatatcactcgctgatggcgcaaaattagtnaaaatcatttcttttaattctcccgttacttcattgaatacaggaaaagcagagaaaatagaaaaaataaccataactaaaggaaccattgctaacattgtgctataagtcaatgcgccagctacttgattaagtttattttctgaaaaacgtttccaaaataataatccaaaattttttaatgaaatcatagaaatcctccacaacaatgtttaaattttttacccgaaccacagacacaaggttgtttcattgtcggtaatgatacggtcggatccacaaaataccaacgatcttcaattttcacaaaaattgaccgttcttgatgggcttgctcacattcttcgccttgaaaaatcgccttaaattccaccgcactttgagtttttgtaaggctttccgtttttagaatttctaatcctagccacgtagtgttgtcagcccattcttgcaataacctaggctttaataaagtttgttggcttggcacagttgttacaacaatatagggaatattttttaacacataagccgtataacgtgaacgcataagttgctctgccgtttcgggaaatgcttgtctcaaatgaaatttgccacaacaatctgcgtaatgatggctagattgacatggacaattttctaaagaaagcgcggttgaaatttctgacatatttatccctgttgtttgaatttcgatatttgcgatcgaattgagcgtttaaaggcttcagctaatacttcaatctctaatgctgaatctaattcagcttcattttttggcgtagataacaagcgatttaaatgacgaattgttatttgcggataaggacgggcgagtaattttaattcatccttttgcttaattgttcctgtttcaataatacgaacataccatccactgagcccagtttgataaacaatatcgcgagtctcttcgttttccgtgttttttgataaacgctcacaaggtttacgtggttgagatacttctaaaatggttgagccgatttgataacgatcgccaatacatacattgtcttcattcaagcctgacacgacaaaattttctccgtatgtcgcagtatccatataaggaaaaatctttatttaataaagcatttaattcattaaaagaatctgccgacataaaaaagagagctttatctacaccaccgtgatgtttttttaaaccaacatcgtttccttccgcaccaagagaatgaatttttaccgatggcacaacttttttacgaatcgcgctttcatactggcttccatcggaaaaggttagggtttcaacttgccccacttttatgactaaaatttttgcattcattttatttttcgcttgttctagaaaaaatttacgtggaattataaccgaaaacgtttaactttttgaccgcacttctttttttacttattattcgttatcagaaaaacaaaaaagaaataatgaaaatgtttgaaagagaaaaaaattttctaaaaatattttatttcttttcttgaaaataagatttttcctaagggcgaaatcatcacgttcaatgataataaggagatttattatgtcaggcgtattccacctaaacctcactaaagcacaacttaaaggtgcaacactcgctattgttcctggcgatcctgcgcgtagtgagcgtattgcgaaacaacttgataatccagagtttcttacaagcacgcgtgaatttacatcgtggttaggttatatcaatggtcagcctattgttgtatgttctacgggtattggtggcccttcaacatcaatttgtgtggaagaacttgctcaacttggtgttcgcactttcttacgtattggcacaacgggtgcaattcaaccgcacattaatgtaggcgatgttcttatcacaactgctgctgtccgcttagatggtgcaagccatcattttgtaccattagaatatccagctgtggcaaactttgaatgtacaaccgcactttataatgccgcgaaagcaaaaggtattgagccttatgtaggtgtaaccgtatcatctgatacattctatccaggtcaagaacgttacgatacttatagtggtaaagtatatcgtaattaccaaggtttgcttaaacaatggcaagatttgaatgtcatgaattacgaaatggaatcttcaacattgtttactatgtgtagcgcattaggtttgcgtgcaggaatggttgcaggcgtgattgtaaaccgcactcaacaagaaattccaaatgaagcaacgataaaacaaacagaagaaaaagctgtgtctgttgtgatcacagctgcacaagcattgttaagttaaattaatatttatttgaaacaataaaactttattttattctgcaccttaattagatttattttctaacgaagtaaggtgcagattttttattaataaactgcgatcttctgatcaatttaatcaaagtagtctatttacttgttggcattgaaacctaaacttgatataagttctaaataaactacttctaaaggctaaataacctaaaatatttacgactaaaattagatttctgttaaatctacatttttagtctcttttgaggctaataatgccaagaaagtcattaatgcattgattgctaaataaattcctacacccattacaccgaatgacgcgttaatttttaaagaaatcattgctgcaattgttgcaccaataattgatgctaaattatacgcaagagaggcacctgaataacggacttctgttgggaataattctggtaatagcgcagccattggaccaaatgtcattcccataatcgccataccaatcactaaaaatgcaaatacgctaactggagtgccattttctaagaataacggcattgctaaaccaagcacgccgatagcaatagtcacccaaatcaaccatttacgacgaccgattttatcggcataaaaaccggaaatactgataaaaataccaaatacaatggcactaattaataacaagccagtaaatgtatttgctgggattcctaaaccaagtgcataacctgcttcagaaagctttggtgctgttcgagaatatgcctgcgcaaaagccgtcataatgtaaaacagagaataagttgccaccataataaatgtgccaataaccattggttttaagtgtttggtaaacacaacactcactggtgcattcaattttttgcctttttgctctgcttccacaaatacgtggctttcgtgcaaagttaagcgaacatataaaccaactgcaactaataaaatggaagatacaaatggaatacgccacgcccattcaacaagtgcattatgaccaagcaaatagctaactaagaagaacgttccattagcgacaaataaaccaattggtgcgcctaattgagggaaagtaccgtaccaagctcgttttccttctggtgcattttctgttgcgactaacgctgcaccgccccattcgcccccaagcccaataccttgaccaacacggcatacgcaaagcaaaatcggcgcccagataccaatttgagcataattaggaagtaaaccaattactaccgttgaaccacccattaaaacaagagaggcaaccaaggtttttttacgaccaattttatcgccaaagtgaccgaataatgccgaaccaataggacgtgcaaagaatgctaaagcaagcgtagaaagagaaagtaaatcattagaaagcggatcatcgctatgaaagaattgcgtattgaaaactaatacagcggcagccgcatagatataataatcaaaaaattcgattgctgtaccgaccatcgaggctaacgccactttcatcggattattacgaagttgtgtagacattgtgtttccttagaagtttattataaagagaaaggattgaatcctagcattttaactaaggtctaacaatttttaatatgcaattttctatttttttagagaaatattttgaattttctaaatgtgagttatgtccagcgcagggaattgtcactaaatcaatttgattttctttggctaatacttggaacttatgatctctttcgccacaaaaataaaaaaatggcaaagaacttaaccgcactttttcactaaaatcaggttgtttggatagacttgtcgccagcaacattttgccaatatttttcccacaatttgattttcgtttttcaaccaactgtaatctttcttctgtagtcaaatgagaaaacacaggttgttgataccaatcattcaacactttttctggcgattcttgcataaaacgttgcgcccaagcaaaatcctgctgaaaacgagcctgcttttcttcgtcagtttttaaacctagattcgcaccttctaaaataacgccttgcaaattagatcgttccagctgagcttgcagcgcataatacaaagcaatcctgccacctagagaatacccaacaagaaaatagggtccatttttcaccgcacttttaatttgctgagccaaatactccgccgaatcttcaaaatttgtgacttcaaggtctttagcttgcccgtgaaaaggcaaatctagcgcaatacaattaaagtgcggtagattttcaatgactttttgccagtcattttttgtaccaagaagtccgtgaagaaaaatgatgtttatcattgaagggattattgatagaaataataaaatatggcggactaaagcccgcctacagaatacttaagcaccaatcacggcgtgactaatttgctcgattaagcgtttatacaaactgctaccatcactcggattcgttttaatttcaattaacgttgccttgcgacgactataagcctgtttcacaacagaattgagatctgcccaagtataaggatgagcgtatttaagatcgaacattgccgcgatttgagaaaaatcgccattatgcggtaatcgatagaactgatctttgacttgttcatccacaggtaacatatcaaaaatcgcgccaccattattattgatcacaaagattagcgttggttgcgtaacgtttttgaataatgcgaaagaattcaaatcatataaagtggacgtatcgccaatcaccgcaacaacaggtttatttgaaccaatacctattccagcagcagtagccaacaaaccatcaattccactcgcaccacgattggtataaacgggataactttctggtaattgcgttagcgcatcaactagacgaacaagtaaactattacctaaaaataaaacaccgttataaggtaaaagtgttggtaaacgtaatgcgagcgaggcttccgttaaatttccgcctacttgctgttcaataaaggtcgcacagaacttagataaagctaacggctcaagcaaccaaggcttttggcgtaaaggtggatgtgcacgcaaccaatgatgtactttagcattaaatcttgtcaatgaatgatggtaaggatctaatgctttaccgctttgttcaactagccaaaattcccctttaaacgcttgcaagaattgattaatgcgtttactaataaaacgcgcgccaaattgaatcacaatatcagcttgtagaagtttttcacgaacagtttggtttgccagccaaatatcttcataaggcgtcgttggaacaacaccagattgaatatccgtcagtaacacccagcccatagcacttgcccaagaattaatgcccatcgcttgttctgcaggtaattgaccaaccacaacgacaccacgtttggtacgccaatgatcccaattttcatgcattaatacttcgttttgttgcgcttctacatttatccaagacttgttttgaattaaccagcgttgtaacggctgtagccaactatgggaatttacttcctcatcagttgcatcataaagtggctcggcaaatgggacattaatatgaacaacgccaccttgttgtttttgttggaaaactgcctgttcaagtagagaaattaaccactgcgcagaataatcagcattcggtttaggtaaattaacatttgcaactggatactgaccaaacatattttgttgcaaaatggcctgatttgcaccgcactcccaaagttctggtggacgatcagcagttaaaacaaataaatttacaccagtttggcgtgcttcaataatggcaggataaaggtttgctgttgcagtacctgatgtaacaataattgcaacaggcgattgagttgccttagcaatacccaaagcaaaaaaacctaaaccgcgttcatcaaaatgcgtatgacaagtgactgcgcccgcattttgcaaacgtacggcttctagagttaaaggtgtcgaacgcgaacctggcgcgatacaaaggtgagaaacgccttggcgcaccaaggtttctaaaatcactttcgaccaacaacgattaaacacgcttaccgacattttttttctccgttatcatttttcttctgcaaacaaggaaattaaccctgctgctttacgttcaatttctttccattcttccaatggctgcgagcctgccacaatgcccgcgccagcaaatactcgaatacgatgaccttcaataaaagcagaacgaatcgccacacaaaactctgaacatacatcgctcatcacgcccaatgttcccgcataccagcctcgatcaaaggtttcgatttctgacaaaatcattttggcttgttgctgtggcaaaccagatactgcagctgtaggatgaatcgcttttaatatatttacatctgcataatgtgcggtcaaatttgcacgaattttacgaatcaaatgttgtactttacgtaacggtttcaattccacattgcttacatcaaaactttctacttgcttacgtaaattctgcgaaatatcttctacaaccaaccaattttcttttaaatttttctcatcatttaacaaccaattggcttgagattgcgtttcttcctcactttcagaaaccgatgctgtccccgccaaagcttcggttagcaacaaattatactcacgagcaaataggcgttctggcgtagaaccaacaaaaaccgaatgagaattttcagcccataaaaaatgataacaaccttgattttgtttttcgctttctgctaaaaaatcgtacgcattaatcgcttgctttaaatgaaaagtggtttcattggctaacacaatttttgtcagctctccacttttaatttctaccaaagcctgatttacccaatcacaccaagttctttcattggctcgaagctctgtatgcaaaggaatttgttttggcaaagcagaaagtgcggtgagattttcaaaagttttgaggtgggctaaagtatcattcgcactttgctcatttttcacaaaaaaggataccaacgtgcctttattatcctgttcaacaagcattttaggtaatacaaattgtgcagtgccttgaaattgcaaaccgccgaccagtggaaaaccactttcttcaataaactcttgcgctaaatttaactgtgaaaatgactgcactgccccaagcgcagccaatgctttttcttcatcacgaaaatgtaaataaaattgaggatacgcagattgacctttcagccacgccaacaaatcgaccttgtccagttttacctgaaaacggacaagttcattcgttgattgctgtaaatatgcgtgaatttgcgattttaactcgcctattgcctgcgctaaataactcattagattttgttttaaatacacaaaaaattagccatattctaccgcagattgttaatgacaaaaaatttttttacaaaatcttttcaatattgaaaattcagcgtaaattaaccgcacttttctcgaaaaatttattagaaacaaaaggatttcactatgcgattattcccaaaatccgacaaattagaacacgtatgttatgacattcgcggacctgtgcataaagaagcactacgcttagaagaagaaggcaataaaattttaaaacttaatatcggcaatcccgcacctttcggctttgaagcaccagatgaaattttggtggacgtattgcgtaatttgccgtcagctcaaggctactgcgattcaaaaggattatattctgctcgtaaagccattgttcaatattaccaatcaaaagggattctcggcgcgaccgtcaatgatgtgtatattggtaacggcgtatctgagcttatcacaatggcaatgcaagcattgctcaatgatggcgatgaagtgcttgtgccgatgcctgattatccgctttggactgctgcggtaaccctttctggcggtaaagcagtgcattatctctgtgatgaagacgcaaattggtttcccactattgatgatattaaagcaaaggtgaatgcgaaaactaaagcgattgtcatcatcaacccgaacaacccaacgggtgctgtgtatagcaaagaattattacaagaaattgtggaaatcgcgcgtcaaaataatttaattatcttcgctgacgaaatctacgacaaaattttatatgatggcgcggtgcatcatcacattgccgcacttgctcctgatttattaaccgttacattgaatgggttatcaaaagcttatcgagttgcagcttccgccaaggctggatgattttgaacggcccaaaacataatgcgaaaggttatattgaaggcttggatatgctggcatcaatgcgtttatgtgccaacgtaccaatgcaacatgcaattcaaaccgcacttggtggctatcaaagtattaatgaatttattttaccaggcggtcgattacttgagcaacgaaacaaagcctatgatctcatcactcaaattccaggcattacttgcgtgaaaccaatgggggcgatgtatatgttcccgaaaattgatgtgaaaaaattcaatattcacagtgatgaaaaaatggtgctggatttactccgccaagaaaaagtactacttgtgcacggtaaaggatttaattggcattcaccagatcacttccgtattgttactcttccttatgtgaatcagcttgaagaagccattacaaaattagcaagatttttgtcggattaccgtcaataatgaatgctttgacaacattacaaaggggactaaatgtcccctttttatcgatataaatatattgcactttccttgtgtactactataatagtgcaaatttattttagaggcattttatgatacaacaaaaatctccttctctcttaggcggtgcaatgatcattgcaggtacagcgattggtgcaggcatgctggctaacccaacttcaacggcaggtgtatggtttatcggttcaattcttgctttaatttatacttggttttgtatgacaacctcaggattaatgatcctagaagctaatctacattatccaacaggttcaagttttgacactatcgttaaagatttattaggaaaaagttggaatactatcaatggtctttctgttgctttcgtcttgtatattttgacttatgcctacataacctcaggcggaggcattacacagaatctgctcaaccaagcattcagttctgctgaaagtgcggtagatattgggcgaacttcaggatctttaattttctgccttattcttgcagcctttgtatggctttcaaccaaagcagtggatcgtttcacaaccgtgttaattgtcgggatggtggttgcttttttcctttctactactggtttattaagctctgtaaaaacagcagttttattcaataccgttgctgaaagtgagcaaacatatttaccttatttattgaccgcacttccagtttgtctcgtgtcgtttggtttccacggaaatgtcccgagtctcgtcaaatattacgatcgtgatggtcgtcgcgtgatgaaatcgatctttattggtacaggcttagcattagtgatttacatcttatggcagctcgctgtacaaggtaatttaccacgcactgaatttgcgccagtcattgaaaaaggcggcgatgtttctgcattattagaggctttacataaatatattgaagtggaatacctttccgtcgcattaaatttctttgcttatatggcaatttctacttcattcttaggcgtcactttagggttatttgactatattgcggatctatttaaatttgacgatagcttattaggcagaacaaaaacaacacttgttacttttttaccgccattattgctaagcctgcaatttccttatggatttgtgattgccattggttacgctggattggcggcaacaatttgggctgcaattgtccccgcacttcttgccaaagcaagccgtcaaaaattcccacaagcaagttataaagtatacggcggaaattttatgattggttttgtaattttatttggcatattaaatattgtggcgcaaattggggcaaacttaggttggtttgcaagttttactgggtaagttttaaaaaataaatttaaattattaaatagcgatctgcactttaacagtgggttatgtagtccaactaattcgtgtagatcagccccttaattattttactttttattagttacaaacaatcttaactgcaagtccgccttgagatgtttcgcgatacttggcgttcatatctttacctgtttcgtacattgtttcaatcactttatctaaagttactcttggattagtggtacggcgtaaagccatacgcgatgcattgattgctttaactgaagcaatcgcattgcgttcgatacaaggtacttgaacttgaccgccgacagggtcgcaagttaatcctaaattatgctccattgcaatttcagctgcgatgcatacttgtagtggattaccacccaaaatttcagctagtcctgcagccgccatggaacaggctacacccacttcaccttggcaacccacttctgcaccagaaatagaagcgttcatcttataaagtgaaccaatcatccctgcggctaataaatagcgttcaatgatttcaggtgttaatggcgagatgaatttttcatagtaagctaataccgctggaataatcccgcacgcaccattagttggtgccgtaaccacgcgtccacctgctgcattttcttcattgacagcaagcgcaaacatattgacccagtcgattacgcgcattggatcgttagataaattcgtatttgcttgcaacgcacgataaagtgaagctgcacgacgtggtactcttaatgggccgggtaaaataccctctgtgtgaatgccgtgttcaatacaagcctgcatcgttttccagacattctctagatgagcactaacagcctctttgccattcaatgcgatttcattttccaacatcacagtggaaagcattaagcgttatcactacaatgtttcaaaatatcttcggcatttttgtaaggataaggcacttggactgtgtttttttcttctttgccaaaatgggcttcatcgacaataaaaccacccccaatcgaataataggtttggcgataaagctctgtgcgattttcatcaagagcggtaattgtcatgccattttcgtgcaattttaaaaaagtgcggtggaaaatgagattattttcaaaatcaaattttactatcttttgaccgacattaatgggtaaaagcgcagtttgtttaactttctcaatgaaacctgaaatcatatcaatatccacattatgtggtaaataacccgctaaccccataataatggcaatatctgtactgtgtcctcgtcctgtcattgaaagagaaccgtacacatctacgtgaatttcagtagtttgttcaaattgatttcgtttaattaagtcgtctataaattgtttacccgctttcatcggaccgaccgtgtgggaactggatggcccaattcccactttaaacatatcaaatacgctaatcataaatttctcaaaattcgttaaaaattaaaggcgattataataatccataaacaactgcagaaatagcaattagccccataattgttacaaatacattactgaaacgtccgctgtagcgtttcattgctgggatttttcgaatcgcgtacattggcatgataaacaaaatcatcgcaatgattgggccgccaagagattcgattaagcctaagatacttggattaataatcgcaacgccccataacgttaataagaagaaaagtgcggtcgcataattgagttttttacgatttactgcttcacctttcatttttaaatataaaccttctaagccttcacgtgcccccatatagtgaccgaagaatgaactagtaatcgctaagaatgcaacaagcgggccaaaataagagatatatggattatcaaatttattcgctaagaaagacaagatactaatattctgttcttttgctgccactaattcttcaggtgttaatgttaatacacagctaaatacgaagaacattacgaagaataacaaaatcgttgaggcgcctttttctgtatggctgatatggcgttctgcaccatcgaaagttttatattcacggaattgtgagcaagtgaaagatgaaattgctggcgaatggttaaatgaaaatactaatacgggaatggttagccataaagttgttaagaaaccgcctactgttggaaattcatataatacggcactattccattcaggaattaagtaaatagaaagracaaataaaattaagactaacggataaacaagccattctgtgatttttaacatcactttttcattaaataacatcacggaaatcaataccgcaattaatacaaaagagagaatgactcgatttggtgatgccataccaagttgattcacaataaaagaatctacggtgttcgtgataccgttaccgtaaatcaacagaatagggaaaatcgcgaaaaaataaagtaaggtaataagtttacccgctgttttaccaaagtgttcttccactacttcagtaatatcgctgccaggattttttgatgaaagtacaaagtaggctaagccacggtgagcaaaataagtcattggcccgacgataattgccattaaaactaacggccaaaatccacccatccctgcgttaatcggcaagaacaatacgcccgcgccaaccgccgtaccgaaaaggtttaacatccacgttgcatcaaatttgttccatttgagtttttctgttgatttcatagtttgctccaaagcataaattacttaaatttgtcaatttgtagagcaaaatccgctccaactaaatttgagtattatgttatgccaataaatagagaatctcaaagagcaaattctaaaattgtgatcaagttaaaatttttttataaaaagtgcggtaattttcagcgacaaaaaaatcggtgcgatgacgacaccgattgcgtataaaaataaatgaaattagaaccgcacttttttcaatcttaaggcgttcatcaatacggaaattgagctcaacgccatagcagcaccagcgattatagggctaagaaaaccgaaagcggcaaggggtatgccgagaatattgtaaatcaaagcaaaaaatagattttgtttgatatttttcaaggttgctcttgcaataaaaagcgcatccacaagttgattcaccgaatgttgcataagcgttgcagaggctgtttgttctgcaatatctgaacttgatttcatcgcaaaactgacgtttgcagaagctaaagcaggcgcatcatttattccatcgcctaccattgcgacaatatgacctagatctttcagcttttggatttgttccgctttatctcttggagttagtttcccaaaggctttcttaatgccgagttgtttcgctatgtaatccacgacagattgttgatcgccactcataattacgacatcaatattttgctgttgtaagcgttgaatggcgtgcaagctatcgttttttaaagtatccgtcagtgcaaatgcaccgatgggttcatcatttatggatactgcgacaatgctcgcaatttgccaaatatcctctaaatttttaggcaagattaaaccgcaataatcaggtttaccgacttttattgttcccacttgttctaattcggcttgaatgccttgacccacttccatctttgaaaaaagtgcggtgggaatttctaacatttttngttctgctgcttgcacaatagcttttgcaattgggtggttagcttgtcgttcaactgctgctgcaaaacgatacaaatcgtcttcagaatacaccgcactttgtggctgccataaagcagagatttcaagctctccttttgttaatgtgccagttttatcaagtacaacggtatccacgtgggcggtttcctccattgcagccgcatctttaaaccatacgccagcattgactgctttacctaaaccaaccattatggctgctggtgtggctaatcccaaggcacaagggcaagcaatcacaagcacggataccgcgtgaattagtgaagacacactatcattcgtcagaatataagtgagtgcgaaagtaacaagtgaaatcactaaaacgacaggcacaaacacggaagtaactttgtcagcaaatcgagcaatgggtgcttttgaaccttgtgcatctgataatgcattcatcatatcgccaagtaaggtttggctaccaagctgatttgctcgatagataatagaaccttctgttaccatcgcccccgctaatacttttccacctttctgtttttcttctgggcgagattcccccgttaaatggctttcatcacaccaaccatttccactttcaattacgccatctgccgcaatacgctcgccttgattcgcacgaatgatttcgccgatattgacttggtcaagagcaatttcaatccatttttcattacgtaaaacagtgacttttttcggtgtcagttgcaagagcatacttaagctatttaggctgtgctttttagtgcgatcttcaagaaattttccaagactgacaaaaccaattaccataacagaagcttcaaagtacacatgtcccattgcatgattggcgtggtaaaacaacatgaaagcagaataaagataaatagtgagcgttcctgtgctgaccagtacatccatattggtaagtccaccacgaatactaccgattgctccgcgataaaatggaatggctaaccaaagttgcacaatgctcgctaatgcaaattgccaaatcggcggtaacattaagttatgggagccacctatcataccaagcattccaatcagaaatggaatattgattatccaaagtacgattaatcgccaagggattgatgtattttcttctattggtaattcgttggcttgtttgatatgggcagagaaacctgttttatggataatctctataatttgassttcgcttgcttgcgtagcgtcaaatacaacttgtgcttcttcggcagcaaaatttacgcctgcttgttgcacaaatggttttttatttaaaactttttcaatgcgattggcacaagattggcaggtcatcccaccaatctgaattgaaatttttttactctgtggcgtcaaatccagcatcttcaatgacctcaatcaactgtgcaacattgactcgattttcatcaaaagtaatatttgctttaccctctaattgcacatcagcagattgtacaccatctaattcagttaaaacttgagtaagattttttacgcaacagccgcaatgtatgccttttatgtttaatgtgatagttttcatttttactccttgttagttgttttattgatgaatgcgattggcaggccatcccaccaatctgaattgaaatttttttactctgtggcgtcaaatccagcatcttcaatgacctcaatcagctgtgcaacattgactcgattttcatcaaaagtaatatttgctttaccctctaattgcacatcagcagattgtacaccatctaattcagttaaaacttgagtaagactttttacgcaacagccgcaatgtatgccttttatgtttaatgtgatagttttcatttttactccttgttagttgttttattgatggttaaactataaacctttacataaggttaaggtcaagaagttttttatgaatattagtgaagccgcaaaattagtaggtttatctacaaaacaaatccgtgattatgaaaaaatggggttaattaaacccgctgttcgcagtttgtcaggctatcgaaattatggagaaagtgatttagaaaggttgcattttattcgacactcacgcaatgttgggttttcgttacatcaaatcgcacaattattagcactacaagataatcctaagcgtagctgccgagaagtgaaagtgctaactgctcaacatattgcgacattaaatcaacaaatagaacagttacaaaaaatggtacaaaaattgcagcactggcacgacagttgtcagggcaatgacaaccctgaatgtttaattttgaatggcttgaacggataagtgaaaagtgcggttaatattcccagctttctggatcgacacctaattcacgcataagcactttggcatcttcagggatttcatcattacgctctttcattaaatctgcatcggtgggtaaaggttgtcctgtgaatgcatgcaagaacgcttcacaaagcaattcactgttagttgcgtgacgtaaactttttaattggcggcgagtgcgttcattcgtcaaaatttccagtactttaatgggaatggatactgtaattttttttacttgctcactttttttgccatgttctgcataagggctgatatattttccgtcccaattcgccataatttcccttaagtgcttattgataaccttacaaattgtccgtattctaattaaaaatcaaataaataacaatctagacggctaaacttccaaaataagttcttaaaaaaagtgcgatgatttttatattaaatgctaataaaagctagacagcgtagggttttagtggtaatttacgtgccattcaaagggtgcaagcccaccattcgaataatcaattcttattaattccaacatttattcattatgcatttaacagaacttaaaaatacgcctgtttctgatcttgtgaaactcggcgaggagcaaatgggcttagaaaatttagctcgtttgcgtaaacaagatattgtctttgcaatcttaaaacagcacgccaaaagtggcgaagatattttcggcggtggtgtgttagaaattttaccagatggttttggtttccttcgttctgccgacagttcctatcttgcaggccctgatgatatttatgtttccccaagtcaaattcgtcgttttaatcttcaaactggggataaaatcgaaggtaaaattcgtccaccaaaagaaggcgaacgctattttgcacttttaaaagttgatcaagttaatgatgacaaacctgaagtttcccgtagcaaaatcttatttgaaaacttaacaccattgcacgctaattcgcgtttaagaatggaacgtggcaatggctcaacagaagatttgactgcccgtattttggatttagcatccccaattggtaaaggccaacgtggtttgattgttgctccgccaaaagcaggtaaaaccatgttgctgcaaaatattgcgcaaagtatcacacataattatcctgatgtagagcttatcgtgttattgattgatgaacgcccagaagaagtgacagaaatgcaacgttccgtaaaaggcgaagtcattgcgtctacttttgatgaacccgcaactcgtcacgttcaagtggctgaaatggtaatcgaaaaagcgaaacgttctgtagaacataaaaaagatgtggtcattttgcttgattctattactcgtttagcgcgcgcttacaatacagtcactccagcttcaggtaaaattttgtctggtggtgtggatgctaatgcgttgcatcgtccaaaacgtttctttggtgctgcgcgtaacgtggaagaaggcggcagtttaacgattattgcaacagcactagttgatacgggttcgaaaatggatgaagttattttcgaagaatttaaaggtacgggtaatatggaattacacctttctcgtaaaattgcagaaagacgcgtattcccagccattgactttaaacgctctggtactcgtaaagaagacttactcacaacagcggacgaattacaaaaaatgtggattcttcgtaagattcttaatccaatggatgaagtggatgcaatggaattcttgattgataagctgatgatggcgaaaaccaacgaagagttttttgaagtgatgaaacgttcgtaaaagcaaccgcacttctatgaagaacaaggggaaaatattatgttttcccctttttaatatccgtaatatttgacgaaataaatgatgacagctgataagttcataaaaggggcaaaaggtaaaaattcttttttcttcctatgaataagcgaaaaacatattccaagcactgaggctaataataaaaagtgcggtaaggtttctaaatgaataaaacttcctaatgccattgctagccaataatctccccgtccaaaggcttcttttccataatagaattttgcaagccaatagattacgtagaaaacaataaaaaaacttgccgcactttttatgctttcagataacgtaagtaatgaaaagttattgtctgctccaaataatcctagagtaagtaaccataaacagggtgtcgtagaaataagttgatagtgccaatcaagataactgattgtccaaagaataataagtgtgagtccgatccatacagtaaaaatagaatctttgaaggcaatttgtaaaaatataaatccaaccccaatactaaaaaaatacctcaaaatatgrccgcactttttttgttgaatagaggcaaagtgcggttgaaatggagaacggttttgtggaaataattcaacgtaaatcgcataaatattttgctgcaaacgcgtaataaaaccagataggtagaaccacaatgcgatccctaagataccgcctaataaaaacattgtgaaataaatcattgaataacagaacccatattaaagataggtaaatacattcccatcataataattccaatcagactgccgatgatcaccatcattaatggttctagcatttgtgagagtaagtcaatttgatgattaagtttttcttggtaattttcagcaatatgctctagcatcaaagcgagttttccgctttgctcgccaatttgtagcatttgttgtgcttccatcgggaaaagatcgctacttacactattagaaaacgcatagccttgagaaacccattgcaaaattgaccgcacttctttatctaatacgatgtcatttacaagcgttttcttggtttgccacgtttgtgtgcgagggagaaaactgtctagtgcctgattaagcggtacgccagcttgcaacataatttgtaaactttgactaaagttcactaaacgtgaaagcttttgaattgtgccaaaaataggcgtgatagaaataagttgattttycttttgataaaaccaagtctggcgttttagatagaaataataaaatagaaaaaaactcaaaacgaaaaatagcaaaatgccaatattttgcttaaggaaattagatattgagagcaatattgcggttattgttggtaactccgcattgttgccactgtacatttcagcaaattgaggcacgataaaaagcagtaatgcgagtgtcaataatagagaaattcccaataccattgagggatataacataattttctgtaatttacgttgtaatgctaaagattggctgcgatgtgtggctatttttttacaaactacggcaagttttcccgtcatttctcccacttgaatcagttgaatttcttgttgtgtgagatatttcccttgttgttcaatggcttgtgagaatgctaaaccagattcaatagattgaagtagtcgttcaagccattcattgagtacaatttgagtacaattttgttgcaaaatttgcagactgttttttaacggaatagcggattgtagcaacgtggctaattgattgagtaattcgctaatttctgaatttttgggctttgccnaaattgccagttttgttgtaatttgatgtgagtaagcccgcggcttattaattgaaagtgtgcttgttgttttgtatccgcaataattgagcctttttgtttctgatttaatgggttactagcttgataataaaagagttttttagtcataaatttttacctaacacacgttcaatttctttctcatccgttatgccttggctaactttttctaaaccactcgcacgtaaatttttaaaatccgtttgatagtcattctgctgccaatgtagaaattgatacacgccgattcgacctcgataaccttgatggcaatcacaagaatttgctaaatttccaccgcactttgaacaaagctttcgtacaagacgctgtgcaataacgagcaataaactgtttttaatttcatactgttgaataccgagttgttgtaagcgagaaatagcagaaattgcatcattggtatgtaaagttgaaagcaccaaatgcccagtttgtgccgcacgtaatgcaatcattgcactttcttcatcgcgaatttcgcctagcataataatatcgggatcttgacgtaaaaaagtgcgtaataggcggttaaaatctaatccaatctgtggattaatttggctttgaataatgccatcaagctcaatttcaatgggatcttcagcagtcataatatgtttatcaggcgtatttagccattgaagtgcggtgtaaagtgagatactttttccacttcctgttgggccagtgactaaaattaatccttgtggctggctaagcacacgttgaaatgcttgttgctgattttctgtcatacctaattcagaaaagctaagttctactggtttattttgttgcgctcgcaacacgattttctcgccccaatgggttggtaaggttgaaaggcgaaaatcaagaatatcggaaaaagtcgttttaaattgaaatcgcccatcttgtggaagtcgattttcactaatatctaatttagccagtaattttaagcgtgaaataatacgattggcgaatattttgcttattaagggttgtggttgtaaaactccatcaattctaaaccgcacttgaaattgatcagccaaggtttctaaatgaatatcagaggcatttttttgtaaggcagattcaaaaatctgattaagtaagcggataacaggttcatcatcttcttgttcaaaatgggtttcttgatgttgatagaatttaacttgttcttccacttgcatttggttcggagtaagttgttgtaacagttctttgagttggctgctttctaacaaaattggttcgacaggttttcccgttataaacgcaatggtttcacaggctgaaagattggagagagaatcaacccctagccagagacgattattttcttctttaagtggcaaagcaaaataacgtaagagcaaggattgttgctgctgattgcgttcccataaatctggcgagatcgtaaatacttcgccatttttagcggttacacgctgagtatgaagtaaagcatagctcgtcattttgtgacacttccgcaaaaatttgctggaaataaagaggcatccgttcctttgcaggttgttgtccaagttacacctgctgcagcattacctttagcttgcaaaatatattccatatttgccaatgtgccattcccttttactgtaataccacctgattgagtgataactgaggctacatagccttttgctgtctttatatccgctgcaataccattttttccccctgtacagcttgttgtttcatttgtgctatatacacataattccacatcagccttataaggcgcagacgcttgcagtaattcggataccgcagcttttttggtataattttgataagaaggaattgcgatggtggctaaaatagcaataattgcaatcacaatcattagctcgattaatgtaaacccttttttcaaggtttgcagtgttgttaatttcattcattttccttttattaagcctttgttggcaacgacattgtgaaaaggaaaaatttgtttgtaaaattgaccgcactttttctgcgatcctgatcgcaaaaaaaaggaaaaatgtatgcgaaaaataaaagatattgagaaaggattgctgaccgattgtcggcaaattcagtcacctcactttgataaacgcccaaatccgcaggatatttccttattagttattcattatattagtctaccgccagaacaatttggcggcggatatgtggatgacttttttcaagggaaattagatcctaagattcatccttattttgcagaaatttatcaaatgcgtgtttcagcacattgtttgatcgaacgaaatgggcgaattacgcaatatgtcaattttaatgatcgcgcttggcacgcaggcgtatcgaattttcaaggacgagaaaaatgcaatgattttgccattggaattgagttggaggggagtaatgaacagccttttaccgacgctcaatatttttcattgcaagaacttaccaatgtaataatgaaaagttacccgaagattactaaagatcgaattgttggacattgcgatatttcgccgaaacgtaagatcgatcctggtcaatattttgattgggaacgttatttatccagtgtgaaataatctgtataaaaattaaacatcaaattttgggtattctgtgtattctaaatgcgttcattcttttacttctaaccagttgaattaaaaggaataaatttaaagctgaaattttattaaaaaagttaatttgagttatacagtattatagattttctcaaccacaattttatccacagaaatattgaataactcaaagagatggtaaaaagatcttttgtgaataaaaccattttaaaaattgtatttttttaccgcactttattgcatttttgtatgtaaaaagtgcggtttatttttatttaagatcttttggttacaaataacccgatttattttgaagtttgatgtgataaggatctttgccctctttttacgagatcaattcacaatcaaaaatccattattcacaagttatccacnacatagatacttttcgtcatataaacaaaataagaatattttgttgtctagaattttcccctctccgtaaaaattgtgtatttttaaccgcactttaggtttaaacccaatgtgcggttattttttattgattttcctcttttcgcgttttgcgattttttctaaaatatgataatttttcgccgtcaataagacatcaaacacaaatcaatatgaacgacgaacagcaaaattcaaaccaatctgaaaatacaaaaaaaccttttttccaatctttatttggtcgcttttttcaaggcgaattaaaaaatcgtgaagaacttgtggaagtgattcgcgattcagaacaaaatgatttaattgatcaaaatacgcgcgaaatgattgaaggcgtgatggaaattgcggaacttcgtgttcgcgatattatgattcctcgttcacaaattatttttattgaagatcaacaagatttaaatacttgtttaaacacaattattgaatccgctcattctcgttttcctgtgattgccgatgcggatgatcgcgataatatagtgggcattttgcacgcaaaagatttattaaaatttttacgtgaagatgcggaagtctttgatttatcttcattattgcgccccgtcgtgattgtgccagaaagcaaaagagtggatcgtatgttgaaagatttccgctcagagcgttttcatatggccattgtggtggatgaatttggtgcggtatcaggtcttgttaccattgaagatattttggaacaaattgttggcgatattgaagatgaatttgatgaagaagagattgcggatattcgtcagctttctcgtcatacttatgctgtgcgtgcgctcacagatattgatgatttcaatgcgcaatttaatacggattttgatgatgaagaagtggataccattggaggtctgattatgcagacttttggttatttaccaaaacgtggggaagaaattattttgaaaaatcttcaatttaaagtaacttctgcagatagtcgtcgattaattcaacttcgagtcacagtgccagatgaacatttggcagaaatgaataatgtagatgaaaaatctgaataggattttattatcaattaaatttatgaataaatattttacttatcttattgcgattatatcaggtttactcggcgtttttgccttttcgccatttgattattggcctttagcctatgtttctttactcggtttactttatgtcgctaaaaatcctaaaaaatccaccgcacttttatccactttcttgtgggcgatgggatttttctgctttggagtaagttggcttaatgtcagcatccatcaatttggtggtgcatcgttaggggtaagttatttccttgtcggtttacttgcggcttatcttgcactatacccgatgctatttacctatttagttcatcatttcaaagtgcaaagtgcggtaatttttgccgtgatttggacattgacagaatttttacgaggttggatttttaccggttttccttggcttcaatttggttatacgcaaattgacagcccattttatggcattgcccccatttttggcgtaacaggattaacgttctttactgtttgggcaagtgcggtcatttttaatctcgtttcctctttgtttaaaacgaaaaaccttaaattagttttagcgaatgctttgttattgatcatcgtggggggattaagtgcttattcatcccgaattcactttgtaaaatctgttgaagataaggcaatttcagtcacgcttgcacaaggtaatattgaacaaaatcttaaatgggatcctaattatttctattctactttggcgatttatcaaaaattaatcacagaaaatcttggtaaaaccgatttaattattttgcctgaatcagccttgccaacgcttgaaaatgcgattacgccattttttgagggattagagcgtgcagctaaagaaacgaaaacggaaattatggttggaactgtattccaagatacaaaatctggtaagttattaaattcaattatgactgctggaaacccagattttccttatcaaccaaatacgcaaaatcgttataataaacatcatcttgtgcctttcggggaatatgttccgctagaaagtattttgcgaccacttaattcagtgtttaatttaccaatgtcagcatttcaaagtggggaggcagttcaaccctctttaatcgcaaaaaaacgtgctttttcgccagcaatttgttatgaaattattttcggtgagcaagtgcgacaaaatttgaaacaagatacggattatttgctcacgttatctaatgatgcgtggtttggcgattctatcgggccttggcaacatttacagatggcaagaatgcgtgctttagagttaggcaaaccgcttattcgtgcaacaaatacggggatttcagtttttgttgatgcgcaaggtaaggtattagcacaagccccgcaatttattgaaacaactttgacttataaaattgcacctgcggaaggcaaaaccccttattctgtgttaggaaatatgcctttgtatgctttatctttattgtttttactcttgcacagtatgatggcgtttattcgtcgtaagatgaatatcttataaaaacaccagttaaaatgaccgcactttttcattcatataaataaacattatgcgcataccaagaatttatcatccaatatcccttgaaaatcaaactcaatgttatctttcagaagacgcggcaaatcacgttgctcgagtgttaagaatgacagaaggcgaacagcttgaactctttgatggttctaatcatatttatccagcaaaaattattgagtcaaataaaaagtccgtaaaagtagagattttggggcgtgagcttgcggataaagaatcccatttaaaaatccatttaggacaagtgatttctcgcggagaacgaatggaatttactattcaaaaatccgtagaattaggggtaaatgtgattacgccattatggtcagaacgctgtggcgtaaaacttgacgcagagcggatggataaaaaaatccaacaatggcaaaaaattgcgattgcagcttgtgagcaatgcggtcgtaatattgtgccagagattcgtccactgatgaaattacaagattggtgtgcagaaaatgatggtgcattgaaattgaatttacatccacgtgcgcactattctattaaaaccttaccgactattcctgctgggggtgttcgcttattaattggctcggaaggtggattatcagcacaagaaattgcccaaactgaacagcaaggatttactgaaattttattaggaaaacgtgttttacgcactgaaactgcatcacttgcagcgataagtgcattgcaaatttgttttggggatttaggcgaatgatggaattacaaggaaaatttttgatcgcaatgccacatttagacgattattttaatcgcacggtggtgtttatgtgtgagcataatgaacagggttcaatgggtttggtaattaatcagccgacagatttaagcatcgcggaactttattcaaaactcaattttatgatgaaaaatgaccgcacttttggtaatgaaatggtggttgcgggtgggcctatgcatacagaaagagggtttattttacataagaatacgcttaatgcttttcaacatacttacaaagtcacaaaggaactttcaatgacaacctccgctgatgtggtggaaacgctaggttcaacttttgcacctgaaaaatatcttgttgcgctaggatgttcaagctggggggctggtcagttagaaaaagaaatcagagataatgcgtggttggtggtgtcatctaacgatcaaattttatttgatatgccctatgaagatcgttatgctgcagccaatcagttacttggtattcatccttataattttgcgttagcgcaagtggggcatagttaatgggaattaccgctctggcttttgattttggcactaaaagtatcggttgtgccataggacaaagtattactggcacagcacaagccttgcccgcttttaaggcgcaagatggcatcccaaattgggaagcgatcgaaaaatgtttgaaagaatggaaaccagatgttgtcattgttggtcttcctctaaatatggacggaacagaacaagatctcactctacgtgctcgtaaatttgcaaatcgtttacaaggtcgttttggcgttaatgttcatttacaagatgaacgattaaccaccacgcaagctcgtagtgagatttttgaacgtggtggttttaaagcattaaaaaaaggcaaaatcgatggagtgtcagcttgtttaattttagagagctggtttgaatacgctgaatattagattcacattgtaaaaataaacttcattttagaatgattaaagcgcgattttataatctcgctttttcgccaccaaattcatctaataaattttcggtgagtttggctaaaataccagtcatcagtacaaaatctgcatcgaaacgctgtgcaaaatcttctttcagaatatcatcatttttttcccgtacagtatctgcaaattttaaacgtttgattgtgcaatcttcgttaaaaacgaaagttaaggtatcttcccattctaaggctaatttacttactacttttttgccatcttgcagaagagcgagaatttcttcattttctaagggttgttttttacaacgaataacgctgtcttcctgactgccacgaagctcggcttcttctaatgcaagtaaccaatgcggcaaattatcttgaaggatccaattggttaaaatcgtgctgggttcattagcaaaggctaaaggcacgacagggagcgaacctaaggatttacgcagtaatgcgagcgcatcttccgcgcgtttacttgatgcggcatcaatatgaataagattattttccgtatcaatccatagtgccgtatgctgatttttactaaatgcacgaggtaataaattcatcacgacatcatcttttaatgtttgtttttctacctttttaagtttgcgattttctttttgttcaaggctttcaatgcggtcatctaattcacgtttgaccacatttgccggcaagattttttcttcttttttggcgattaatagaatttgttttccaacagaaaaatagagtaaatcacttcctcgtaatggagcagaccagccaaatttactttgatcttgagtgccgcaaggatggaattgacaatcttccagttgagtttgtagctgtgcaagatcccaatctagcggtttagtcagtctataagtcattaaatttttgaaccacatcgtaacacttccttcaatatagggtagaatgtgcggtattatagcccataaaagtaggaaaaacgatgcaacacaaattgattgcctttattggtggcggcaatatggcacaagctattattcttggattattgaaacaaggttatcctgccgagcaaattattgtgaatgatccaaatgaagaaaaaagagcattttttgctaatcttgacgtggcaacttcagaaaataatgtgggaagtgcaatcaaagctgaggttgtgttgcttgcggtaaaacctcaaatgatggctgaagtttgttcgccactaagtgcggtggatttttccgacaaattgttaatttccattgctgcgggtatttcaactgaacgcttgaacgcattaattccaagcgtaaaatcgatagtacgcgtcatgccaaatacgcccgcattggtgggggaaggtatggcgggtttatttgcaccgaaaaatacgagtgaaaattaccgcacttttgcacaagatttattgggagcagtgggaagaacggtttgggtgaatgatgaaactcaaatgcacgcagtcactgccgcgtcaggaagtagccctgcctatttctttttaatgctggaagcaatgcagaaagccttaatcaaaatgaatattgatgaaaaaacagcgcgtgaattagtccagcaatctatgcttggtgcagcaaaaatggtgacagaaaatccgcaaattgcactttcaactttgcgtgaaaatgttacctcgaaaggtggcactactgcggcagcgttagcagtatttgacgcacaacattttaatcaaacaatagagcaagctatgcaggcttgtttgtctcgttcacaagaaatggaaactttattctaatgcaagtccgtcctttttattggctcgcactgagctttctaggttactactgcgcttatggcgtgtttttgccgttcttccccgcatggttgaaatcgcaacaatatggcgaagaaatgattggtttggtgatcggtagtgcttatattttccgatttgcgggcggattatttttttcatcgctgattaaaaaagccaatcatattattattgccttacgcctattggcgttagcatcggcaattattatggcggctatgagtttagttgcgcataatttttggctgttatttattgctatcggtttgtatgcttctgtgaattcagcaggaatgccgattggggattcgttggcatccacttggcaacgccaaatcggcttggattacggcaaagtacgtttaattggctctgctgcttttatccttggcgtagtggtgttcggcggcatgattggctgggttggcgagcaaaatatcgtgtggattttaaccgcacttttatctttctataccatcattcagcttttaaaacccaccattcccccaaaagatgaaatacctgaagatagcgttcaaaatgatgttggttttattgctttactgaaaaatccgatgacattgcgagttatgatagcagtagggctgattcaaggctctcatgcggcttattatgtttatagcacgatttattggacaagtattgggatctccgtttctcaaactagcttactttggggcattggcgtattagcggaaattgtattatttttcttctctcgtcgcttattccaaaatatttctatcagtgtgctgctttatatttctgcgcttgcgtgcgttggacgctgggctgtaataggatatattgaagatttctggttgatattcttattgcaacttatgcacagtttaacctatgccgtttgccattatgcgattgttcgctatatcaccacgcaaccgcaaagccatattgcgaagttacaaggtttgtataatggtttatccaatggtgtgctcattgctattttcactgcgattgctggcatgatttatccaacgtcgccagcgatgacatttgtatttatgagtatcattgcagctgctgcattttttgtgattccacgtaagttaaatgcctttttgattgttcagcataaataggacgcattgctttccttgtagaaaagtaatatgaaaaatcttgcgctcattgatttgtttcttaacgaatattggattgaaaaagggctttcagaaaataccgttcaatcttatcgtttggatttaaccgcactttgtgattggttggataaaaacgacttgtctttggaaactttagatgctgttgatttgcaaggttttctaggagagcgtttggagaaaggttacaaagccacgagcactgcgcgaatgttaagtgcaatgcgtaaacttttccaatatttatatcgggaaaaatatcgagtggatgatccaagtgcggtgctaagttcgcctaaattacccagtcgcttgccaaaatatttaaccgagcagcaagtgtcagatttgctcaatacgccaaatgttgaagtgcctttggagttgcgtgataaagcaatgttagagttgctttatgcaacggggcttcgtgtaacggagttagtttcgcttacgattgaaaacatgagcgtgcaacaaggcgtggtgcgagtgattggtaaagggaacaaggaacgtattgtgccaatgggggaagaagctgcctattgggttcgtcaatttatgctttatggtcgccctgtgctattaaatgggcagagttctgatgttgtgtttccaagtcagcgcgcacagcaaatgactcgtcaaactttctggcatcgtgtaaaacattatgccattctcgcggatattgatgctgatgcactttctcctcacgttcttcgccatgcttttgccacccatttagtaaatcacggtgcggatttacgcgtggtgcaaatgttgttgggtcatacagatttatctacaacacagatttatactcacgtggcaaaagaaagattgaaacgattgcatgaaagatttcatcctagaggataatttcggggtaaatttttatagttttaaagattgattgtggatttcttattgattaattaatttgacacgcatcacaaattttgaataaaaaattagacagctcaagcatattttgctatcttgcgaaaaatttcgacatttgttctatcgaaaagtaattttggattctaaaatgaaaaaaatcacgcttttttttaccgcacttttatgcttattttcaacttctgttttagccgaatctaattcaatacctaaacaatgtgaacaactatttaaagaaacagagaatttgattgcccaagcagaaaaacaacctggaacccacattcaagtaaataaaatcaaaagtaaactaaaccaaagcaaacaacaaattcttcaaatggaattagcgactcagttaaaaagttgtgaagtgggtttagcaaaattaagtaacttgaaaagttatagtgagtaattaaaaaagccttattgagtacaataaggcttttttagtggttaaatttatctagtctgataatttctgcaaaccaaaatgacgataagtttgcgatgttgcaatacggccacgtggcgttctttgtagaaacccctgttgaatcaaataaggctctaacacatcttcaatggtatcacgttcttcgccaattgcagcagcaagattatctagccccacagggccaccatcaaaacgctcaataactgcagacaacaactttctatctaaataatcaaatccagcatcgtctacatctagcattgaaagtgcttgttttgccacatttatagaaataataccgccattacgtacatctgcataatcacgcacacgtcgtaataaacggtttgcaattcgaggcgtgcctcgtgaacgacgagccacctcaaaagcggcttgttgttctaattcaagatttaaacagcccgcacttcttgcaacgatagatgttaaatcttctacagaataaaactccaaacgttgcacaataccaaaacgatcacgcaatggagaagtcaaagaacccgctctagtggtcgcgccaaccaaagtaaaagggggcaaatctaatttaatggaacgagcagcgggtccttcgccaatcataatatccaactgatagtcttccattgctggataaaggacttcttcaatcgcaggggaaagtcgatggatttcatcaataaataacacatcatgcggttcaagattggttagcattgcagccaaatcgcccgctttttctaacacaggccctgatgtcgtacgaatattcacgcccatttcatttgccacaatattagcaagggttgtttttcccaagccaggagggccaaaaatcaataaatgatctaaggcatcttgacgtagtttggctgccttgatgaaaatatccatctsstcgcgsacttgcggctgcccaacataatctgctaatagtttaggacgaatagsacggtcaataacatcttcatcaaccttagcttgcccgctaataattctatctgcytcaatcatatttttcctacaatgcgacttttaatgcttcacgaataacttgttcactggttaattcaggtttagcaacgcgttttaccattttttctgcttctacaggtttataacctaaagcaatcaaggctgaaattgcttcatcagatgaactttccgagtgggattcaatagatggggataatggaatatgcgtactttctacaaagaaatcgctttgttttacgcctttaaatttacctttgagctcaactaacaaacgttcagctgtttttttgccaacacctggaattttagtaagtttagaaagttcttctctctctattgcataggcaaattgttcgaccgacatggcggataaaatcgctaaggctaatttaggccccaccccatttgttttaattaattcacgaaataaagtgcggtctgttttctgggcaaatccaaagagtaagtgagcatcttcccgaacaacaagatgggtgaataaagttgtttcttgtccaatttctggtaaatcatagaaactcgtcatcggcaaaagcaattcatagcctacgccttgcacattgagtaaaatttctggaggttgtttttctaaaagaatgccttgtaagcgaccgatcataattcttccgaatgataaaaaaattaacgcatagaataaaataaaactggacgaacatccagttaaatttttaatctaaagcgtcctcggctatatctggtctttaaaagtgcggtcattttttcttgcgtttctgtcattttcacagaattggcaatatgtaaagaatgttgaatagaatgcgcgtgtgtaatcgcaatagccaacgcatccgctgcatcggcttgaggtttatctgacaacttcaaaatacgagtcaccatttcttgcacttgcactttatcagcggaaccaatgcccaccactgtttgttttactaaacgtgcggcatattcaaaaacaggtaaatcattatttaccgctgcaacaatcgccgtgccgcgagcctgcccaagtttcaatgctgaatccgcattcttcgccataaacacttgctcaatcgcaaacatattaggttgaaattgcgtgatgatttcagttactccagcataaatgcgtttcaaacgggtgggtaaatcttcaacttgagtacgaattgcgccactaccgagatattctaaatgttttcctgtttgacgaatcacaccgtaaccagttacgcgagagcctgggtcaatacctaaaataatgctcataatttctataaaaaatgggtaattaaattacccatttattgcatcattaaagttgagatgccacttcgtcacagatttctccgttgtgatatacgttttgtacgtcatcacaatcttccaacatatcaattaaacgaagtaattttggtgcagtttcaatatcaagatcgacggttgttgatggaatcatcgttacttcagcttcttgtactttaaaaccagctgcttcaatgccatcgcgcactgaacctaaatcttcccaagcagtatagatttcaaatgaaccatcatcttgtggttgaatatcatcagcacccgcttcgattgccgcttcagttaaggcatcttcatccgcttctgcgattaagattaaaccttttttgctaaataaataacccacagaaccttctgttcccaagttaccaccacatttagtaaaacttgggcgtacttgtgagatcgtacggtttgcattatcacttaaacattccaccataaccgctgtaccgcctgggccataaccttcatagattttggtttccatattggtatcatcgccaccgcctacaccacgatcaatagcgcggttgatagtatcgcgcgtcatattgttgctaagtgctttatctactgctgcacgtaaacgtgggttagcactcacatcgccaccaccaattttagctgcggtaacaagttcacgaattaatttagtaaaaattttaccgcgttgtgcatcttgtgctgctttgcggtgtttaatattagcccacttactatgacctgccattttatttccttctgttttgatcttattgatcttgatttaattaaacgttttgacctaggctaggtatagcctaggttagtaaaagtgttaccccgttgggagtggatgtagcttttcccaaaagagaaccgctatcaccataattagctgtgattatacttacctacggagattaaaaagatattttttaatagcttccgcattattctgggatttcgtcatttctactgcttttttcgccgacacccagsaaaaatctaaatgctcactcaatactggaataaattctttttccacctcacacaaaaaccaatgttctttgcagtgagtaatattcggtgcgtatttatagcggaaatgtggaaaaatttcaaattctatgctctcattgcaatcaaaaagtgcggtggaattttccgaaatgtctaaccgcacttcttcccatagctcacgaattgctgttttttttggtgtctcatcactttcaatagtgccagtaacagactgccaaaaatcaggatcatcttggcgttggagcattaaaactctgtttgtatctttagtgtaaattacaacgagaacagattgattatttttgtattgcatcattaaaaatgcggtcaaatctgaccgcacttcattcctaatatttcaaacttattctgctttaacgacagaaattgccaactcttccaatgcttgcggatttgcaaaactcggggcttccgtcattaagcacgctgctgccgtggttttcggaaaggcaatcacatcacgaatgttttccgtgcctgttaaaagcatggttaagcggtctaaaccgaatgctaaaccagcatgtggtggagtaccaaattttaacgcatctaataagaaaccgaatttctctcgttgttgttcttcgtcaataccaagaatacggaacacagtttgttgcattttcggatcaaaaatacgcacagaaccaccacccacttcgtagccgttgatgaccatatcgtaagcattggctaccgcacttgttggatcagcctctaattgctctgggctgaaatcttttggtgaagtgaatggatggtgcattgctgcaagattaccttcttcatcacgttcaaacattgggaaatcaatgacccaaagcggttgccattcgtctaaacgagttaagccaagatcacgacctaatttcaaacgtaacgcacccattgcatcagtggtagtttgccatttgtctgcaccaaagaataaaatatcgccagtttgtgcattcacacgttctgctaaccctttccatacatcttcatttaagaatttcgcaatcggactttgcacgccttcaagaccagcattaatatcgtttacttttgcccaagccaaacctttcgcaccgtagatgcctacaaattgtgtatattcatcaatttgtttacgagtaatttctgcaccatttggtactcgaatgactgcaacacggccatttggattgtttgctggctcattaaatactttaaattcaacatctttgacaatatctgctacatctaccatttctaatggattacgcaaatctggcttatcagaaccaaaacgacgcattgcttcttgccaagtcatcactgggaatttacctaagtccacaccaatggtatcaagccataagccgtgcaccatgcgttccataatttcgcggacttctggcgcagttaggaaagaagtttccacatcgatttgagtaaactcaggctgacgatctgctcgtaaatcttcatcacggaaacattttacgatttgataatagcggtcaaaaccagacatcattaaaagctgtttgaaaagctgtggtgattgcggcaatgcatagaatttgcctttatgcacacggcttggcactaaatagtcgcgcgcgccttctggcgttgctttggttagcattggggtttcaatatcaagaaaaccattatcatccataaagcgacgcacaaagctggtgatttttgcacgggttttcaaacgctgcgccatttcaggacgacgtaaatctaaataacggtattttaaacgttgttcttcggtgttattttggttgaagtctaatggtaaaacgtcagaagcattgtagatgcgtaattctttcgctaacacttccacttcgcctgttgccatatttttattaatttgattatcaggacgagcgatcacctcgcctttaatttgaatacagaattcattacgtaacccagcagccgctgtcaatgcatcttgatatttaggatcaaaacaaacttgcacaataccatcacgatcgcgcatatcaataaaaatcaagccacctaaatcacgacggcgatgaacccaaccgcttaatgttacgtcttgtccgatattgttacggtttaatgctccgcaataatgtgtacgcatcatttcaaaatcctttgtactcttttaattatgctcaaaaatctgtcgcaattatagcggaaaaccaagagagataaaaaggttatttatgctgacaaatcaatcaaaaaagcaaagaaaagtaataaatattcaaaataaaggcttttttgtgccatatcatcagattttttgttatattatgccgcttgttgagattaaattacgttaaggataaccacatgttatttatcaatattacttttgcctgtattttagcgatccgtttttacagtctgtctatttcaattcgtcatgaaaaagcactcattgcaaagggtgcaatacagtatggtaaacgcaattccacactgttgtccattgcccatgttgcattttattttgcggcgatcattgaggctaataagcaaaacctgtcatttaatagcacttcacaaatagggttggcgattttaatttttgctattgcaatgctattttatgtgatttatgagctaaaagagatttggacagtaaaaatttatattttaccagaacatcaaattaatcgatctttcttgtttaaatacgtacgtcacccaaattatttcttaaacattattcccgaattaattggtttatcgcttttctgtcaggctaaatataccgcattggttggactacctatttatttgcttatcttagccgtgcgtattaaacaagaagagagtgccatgtcgcatttatttcctaaatcataatttataaatttcttctaaaagaacgactctttctctctgcctttaacacattatggtaaaagatactctattttctacccccattgctaaattgggggatttcatctttgacgaaaacgttgctgaagtctttccagatatgattcaacgttccgtgccgggctattctaacattattactgcaatcggtatgctggctgaacgtttcgtcacggctgatagtaacgtttatgatctaggttgctcacgaggagctgccacactttctgcacgtcgaaatattaatcaacccaacgtnaaaattattggtatcgataattmctcaaccgatggttgaacgttgtcgccaacatattgcggcatatcatagtgagataccagtagaaattctctgtaatgatattcgccacgttgaaattaaaaatgcctcaatggtcattctcaacttcaccttgcaatttttaccgcctgaagatcgcatcgcattgcttaccaaaatctatgaaggtttaaatccaaatggcgtattagtactttctgaaaaattccgttttgaagatactaaaattaatcatttactcattgacttgcaccatcaattcaaacgtgccaatggttatagcgaattagaagtgagccaaaaacgcaccgcacttgaaaatgtgatgcgtacagattctatcgagacacacaaagtgcggttaaaaaacgtaggattttcacaagtagaactttggttccaatgctttaattttggctcgatgattgcggttaaataaaacaacggtaatttgatcntcttgcttgcatacagcaattgaaatgattagtatatacttatttaaatacatagtatatacgagagggtaaatatgcttactaaagtgtttcaaagtggtaacagccaagctgttcggatcccgatggactttcgttttgacgtcgataccgtagaaattttccgaaaggaaaatggggatgtggtattacgcccagtttctaaaaaaacagatgattttcttgcgttatttgaaggatttgatgagacctttattcaagcacttgaagcgcgtgatgatttaccgcctcaggagcgagaaaatttatgatttatatgttagacaccaatatcattatttatttaatgaaaaatcgccccaaaattattgccgaacgagtatcacaattattgcctaatgatcgcttagttatgagctttattacttatgctgaacttattaaaggcgcctttggtagtcaaaattatgagcaatcaatacgagcaatagaattacttactgaacgagtgaatgtactatatcccaatgaacaaatctgtttacattatggcaaatgggcaaatacactcaaaaaacaagggcgacctatcggaaataatgatctatggttcgcttgtcacgcattgagtttaaatgccgttcttattacacataatgtaaaagaatttcagcgaattacagatcttcagtggcaagattggacaaaatagataattctgattttttattttacttatgacataatctgtttaactcaactaaaaaaggacaaaccaatgcaaattttacacactatgttacgcgtgggcgatttagatcgttcaatcaaattttatcaagatgttttaggtatgcncttattacgcaccagtgaaaacccagaatacaaatatacgctggcttttttaggttacgaagatggcgaaagtgcggcagaaattgaattaacatacaactggggcgtagataaatatgaacatggcacagcatatggacatatcgctatcggcgtggatgatatttatgcgacttgtgaagccgttcgcgcgagcggtggtaacgttactcgcgaagcagggccagttaaaggtggctcaaccgtcattgcttttgttgaagatccagatggttataaaattgaatttatcgaaaacaaaagtactaaatctggtttaggcaactaaagtgcggtcaatttttattgtatttttaataacgtagggattcctacgttattttatttttaagagatagattatgtccgattctcaagaaatcccttatcacaaccaattaaaaaatcgctttcgtggctatttccccgtcattattgatgttgaaactgcaggttttgatgcaaaaaaagatgcgttactcgaactagccgccatcacattaaaaatggatgaaaacggttatttgcatcctgatcagaaatgccattttcatatcaagccttttgaaggcgcaaatattaatccagaatccttgaaatttaatggtattgatattcacaatccactacgtggcgcggtgtctgaacttgatgcaatcacgggattatttcaaatggtgcgtcgaggacaaaaagatgcggattgccaacgttctatcattgtggcgcacaatgccgcttttgaccaaagttttgtgatggctgccgctgaacgcactggcgtaaagcgtaatcccttccacccttttggcatgtttgataccgcaagtttagcgggcttaatgtttggtcagactgttctcgttaaagcctgccaagcggcaaaaattccttttgatggtaaacaagcccattcagcgttatatgataccgaacgcacggcgaaattattctgctatatggtcaatcatttaaaagatttaggtggtttcccacatattgcgtctgamctagaacaggaaaaaacaactgaaaaagagaccgcactttaagaaaaataaaaaactggttgcaatcgttttatttttccagtagtttaaaagcaattcttatttggagataaaaaatgaacattatccgtcgtcaccatcatcaccattcaactgaataatctttcaggtttttggtgtgcttggaagatttcttccgagctgacaggataataaaaatcttacccctcggaaggcaactttcgaggggttttgttttatttacgatataggaggcattaatttagcgttattctttattcaataaaaattttaaagtaaagtatttatcatttaatttacaaggaaaaacacaatgttatcaaaccctgttgttatctcaatcatcgttttgctggcacttagtttgctacgcatcaacgttattatcgcactggtgattgctgcgcttaccgcaggatttatcggtgatttaggtttaactaaaaccatcgaaacctttacaggcggcttaggtggcggtgctgaagtcgcaatgaactatgcaatacttggagcgttcgccattgctatttctaaatcaggaattactgatttaatcgcttataaaatcatcacaaaaatgaataaaacaccaactgctggcaatttaacttggtttaaatatttcatttttgcggtattggcattgtttgccatctcctctcaaaacttacttccagtgcatattgcttttattccaatcgttgtaccaccactactttcaatctttaaccgtttaaaaattgaccgccgtgcagtagcttgcgtacttacatttggtttaactgctacctatatattattaccagtaggctttggaaaaatctttattgaaagtattttagttaaaaacattaatcaagctggcgcaaccttaggtttacaaacaaatgtagcacaagtttctttagcaatgttgttacctgttattggaatgattttaggcttactcacagccatatttattacctaccgtaaaccacgtgaatacaatatcaatgttgaagaggcaacaactaaagatattgaagctcacattgctaatattaaaccaaaacaaattgttgcaagtttaatcgcgattgtcgcgaccttcgcaacacaattagtcacaagttcaactatcattggcggtttaattggcttaattattttcgtactatgtggcattttcaaactaaaagaaagcaacgatatttttcaacaaggcttgcgcttaatggcaatgattggctttgtaatgattgctgcttcaggttttgcaaatgtgattaatgccaccactggcgtaacagatttagtacaaagcctaagttctggtgttgtgcaaagtaaaggtattgccgcattattaatgcttgtcgttggtttattaattacaatgggtattggctcatcattctctacagtaccgattattacatcaatttacgtaccactctgtttatcttttggtttttctccattagcgacaatttctattgtaggcgtagcagcggctttaggagatgcaggttcgcccgcatcagactcaacattaggcccaacatctggcttgaatatggatggcaaacacgatcacatttgggattctgttgtacctacctttattcactataatattccattattggtattcggctggattgcagcaatgtacctttaacgattataatcccccacttgggggatttttttatgactgttcaacaacttatccaacgcttagatcaaaaagttcaacaactttatcaagctcatttatccaaacgagaagaaaaaatcttcgccaaatttgaccgcactttgttcagtgaaaatggacaaaatgtttccttttatctaaaagaaatcaatcaaacgctagatagaataaagacattagagtctaacgattctaatcactataattttctagctgagcgtttactcgccaatgttccgttctttcggaagctttagttcgcaaaaatactcatctaactgaatcccaaacaacaacgaaacaaaccattcaaaaatctcaacatagcattcataaattaccaccaagagaacgcctagaaaaatattacgaagcacgagaacaattgaataatctttatcgacagcataaagatttagcacaagctgaaaaaaataatgatgagaaaatacgttatgctcaacttgcagaagtttataaaaaacgccagcaaaaatgccaagatgcaatcgatcttttagaagaatatttggtgtttaaagaagaagtggaaaaccgtgaaaatacggaaaacaaatgattagaaataaaaaactaattcttccgaattagttagctcgtaaaaattgatggcggaggaatagggattcgaaccctaggagggcgtaaaccctcgccggttttcaagaccggtgccttcaaccactcgaccattcctccgtgatttaacgagcgtgaataatacgttctctaataaaaaccgtcaagtagaaataatctcatttttatcaagtgattatttttaccacagcttataaaaaatgcctttcctatttatgaacggaaaggcatttttgttgaatgaatttcagtgctttttattactacaatatatcgcagaaattaaccgcacttttgtcatctaaacaattattttacgcgagagacgtattcgccagagcgggtatcaactctgataacttcgccgatttggacgaaaagcggcacttttacaactgcgcctgtgcttaatgttgcaggtttaccgccagtgcctgcggtatcgcctttaagacctgggtctgtatcgacgatttctaattcaacaaagtttggtggcgtaacagtaattggtgcgccattccataaagtcacgatacaatctgcttggtctaataaccatttttctgcatcgcctacggcttttgcatctgcagagtactgttcaaatgtttctgggtgcataaagtaccagaatgcatcgtctttgtatgaataagttaagttaagatccataacatcagctgcttcaaccgaagtgccagatttaaagtttacgtctaatactttgcctgaaattaatttacgaatacgagtacgagtgaatgcctgacctttgcctggttttacaaattcattttcaacgatgacacaaggctcgccgtcttgcataaattttagacctggtttgaaatcactggtagtatatgtagccatatttgaaatatcctaaaaatgagagatggtttgaaaagtgcgtattttaccccaagaacccgtcattagagaagaacaaaattggctcacaattctaaaaaatgccatttcagatcctaaattattactaaaagccttaaatttaccagaagatgattttgagcaatccattgctgcgcggaaacttttttcgctccgcgtgccacaacctttcattgataaaatagaaaaaggtaatccgcaagatccccttttcttgcaagtgatgtgttctgatttagagtttgtgcaagcggagggatttagtacggatcccttagaagaaaaaaatgccaatgcggtgccaaatattcttcataaatatagaaatcgcttgctctttatggcaaaaggcggttgtgcggtgaattgtcgttattgctttcgccgacattttccttacgatgaaaacccaggaaataaaaaaagctggcaactggcgttagattacattgcggcacattctgaaatagaagaagtgattttttcaggtggcgatcctttaatggcgaaagatcacgaattagcgtggttaataaaacatttggaaaatataccgcacttacaacgtttgcgtattcacacccgtttgcctgttgtgattccgcaacggattactgatgaattttgcactttattagcagaaactcgtttgcaaacagttatggtgacacacattaatcacccgaatgaaattgatcaaatttttgctcatgcgatgcaaaaattaaacgccgtgaatgtcacgcttttgaatcaatctgttttgctaaaaggcgtgaatgatgatgcgcaaattctaaaaatattgagcgataaactttttcaaacaggcattttgccttattacttgcatttgctggataaagttcaaggggcgagccattttttgattagcgatattgaagctatgcaaatctataaaaccttgcaatctctgacttctggctatcttgttcctaaacttgcacgagaaattgcgggcgagccaaataagactttatacgcagaataagatccgataaaatacacataattttttcgccgcacttttgagcttctcaattttgtggctaattaatataaataagaacaagcatcagaggcaatccagtgaattctatggataaaaatcaacaatcatctcaaaatgaattggatttagggcttaatcaagagccaattacaccaaagaaaacaattcagccaagttcgtcaattttaggtaaagcaaaagggttatttgccaaaaaaaatcacgtgcaaactaactttcagcaacgtaaagaacctacttttggcgattcatcaacgcaagaaaatgatcctttaattccgagtgaaaatttgaaaaaagtgcaaaagcctgttcttcaaacttcttccacagaagaaaatatttctgcggttgatgaagaaatcagtgctgaaaataacgcggatgaacccgtcgaaaaggctgaaaaacctattttagctcaaccagaaaaatggaaaatattacaagtattgccagcaaaacatcgccgtttatttatggctatttttgtgttggttattttattgattattttcttcgcattaaaaccaagttctgacaccgttgagtcttttactcaatctaacagcaatgaagttcctgtgcagttccaatcgttagatcaaagtcagccactggaaaccacgattttagataatcctcctgcacaaaatcaaatggctgtagaacaagctaaccaatctgaatttgcaccaaaagcagaggaagcggcgaataatacgacggctcaaaacccattagtagaaaatgcgccaatgcaacaaaatgttgttcaatctccaagtcaaatgccaaatgaaatggctgcggcatctgttgcgcctatgcaaccagctcaagcggaacagccaaaagcaactgtgccagttcagccgatgaaaaaagcggtagagccacaagttgcgcataaagatacagtgaaaaaagaagtgaaagtggcggagaaagcacaggctccagcaaaagcaacggaacaaaacgtcgctaaaacagcaggaaacgcaccgattgttgaagccaaacctgttcaagctaaaaaagaaaagaaagttcaaatcgttgatgcaaaacctgtgagtaaatctacagcttctcgcctttcagcaaaaacattaactgtgccgaaaggtgtttcgctgatgcaactcttccgtgataatcaacttaatatttccgatgtaaacgcaatgagcaaagcgacaggggcgggaaatgttttaagtagctttaaatctggcgataaagtaacggtatctgtgaataatcaagggcgagtaaatgaaatgcgtttatccaatggtgcgcgttttgtgcgtcagtctgatggttcttatcaatataaaaaataattttttgggcgagtaatcgcccctttttctttttaagttcttttctcaaggtaggatttatgttgaaaaaaacatctcttatttttaccgcacttttaatgactggctgtgtgcaaaatgcgaatgtaacaacacctcaagcgcaaaaaatgcaagtagaaaaagtggataaagccttacaaaaaggcgaagctgntcgatatttatgtcaagatgatagagttgttcgtgttgtacacgccacgcataaaaaatacaaaaaaaatttgcattatgttactgtcacttttcaaggcgtatcagaaaaactaaccttaatgatttctgaacgtggtaaaaattacgccaatattcgttggatgtggcaagagcgtgatgattttagtacgctaaaaacgaatctcggcgaaattttagcaacgcaatgtgtctcacaaacaagtgaacgcttatctggacaataatcgtgcaaagcgaacttcaacgtggttttgttttgcatcgtcgcccttatagtgaaacgagcttattggtagatttattcactgaagaaagtgggcgtttaaccgtgattgcaaaaggggcgcgggcaaagcgttcatcttggaaatcggttttgcaacctttcacacctttattgttgcgttggacgggaaaaagcacattgaaaaccctcactaaagctgaacctgccgcaattacactgcctttacaacaaatcgccctttatagtggattttatgtaaatgaattactcactcgagttattgagtctgaaacgccaaatcctgcactttttcaacattatttaaaatgcttaacgggcttggcaacggaaactaatattgagccaacgttgcgtctttttgaatttcaactgttacaaattcttggttacggcgtggattttctgcattgtgctggttctggcgagccagtggatttctcaatgacataccgttatcgtgaggaaaaaggtttcattgcgtctttagtgaaagataatctcacgttttacggcagagatttgttagcctttgaagcccttgatttttccgatgatgcggtacgtcaagcggcaaaacgttttactcgtattgcactgaaaccttatcttggcgataaaccgctaaaaagccgagagttattcactcaaaatattttacttttaaaataatggttcttctttataccccaaagcaaaaaacaaaaaatgttcaaaccattacggctgatattcttgatttagattatcaaggtttaggcgtggcgaaaattaatggtaaaacttggtttattgaaaatgcgcttccgcacgaaaaagtggaatgtcgtattttggaagataaacgccaatatggacacgccattgtaaaaaaatggcgtgtaaaaagccctgaacgtttagaacctaaatgtgctcattttatgcgttgtggtggttgccaaggacagcatattcctattgaaatgcagagaaaagcgaaagaatctgcattgtttaaaagattaagtaaattacagtcagaaccgatttcatttcaacctatgatttgtggcgatgcttgggcgtatcgtcgtcgtgtgcgtttgagtttatggtttaacccaagcacaaaacaaatcgaaatgggctttcgtcagaaaaataccaacgatttaatacccgttcaatcttgcgaagtagcagaacctgcaattaattatttactgcctaaattaaccgcacttttagaaaaattttcagcaccgaaacagcttgggcatattgaattggtggctgccgataatggtgtcgcaatgttgttacgttacaccaaaaaccttgcggaaattgaccgcactttattgcttaaatttgctgaacaagaaaagttaatgctgtttttacaaagcgacaaaggcattgaacaaatctatggcgatgcaccttattatcaattttctgatggcataaaattacattttgatattcgtgattttattcaagtaaatagtgcattaaatgaacctatggtcaatacagcgttggattggcttgaattgagccaacaggattgtgtgttagatttattttgcggcatgggaaattttacgcttcctctcgccaaacgcgtgaaaagtgcggtaggaattgaaggtgtttttgaaatggtacaaaaagcagcgcaaaatgccgagagaaaccaaatcaaaaatattgaatttttccaagcggatcttgaccaatcctttgttgaacaaccttgggctaatcagtcgttcaataaaattttgcttgatcctccacgcagtggcgcagctttcgcgttaaatgcgttgtgcgagttgaaagcagagnaaattttatatgtgtcttgtaatcccgcaacattagtgcgcgatgcggaaattttatgtaattttggctacaagattgaaaaaagtgcggtgatagatatgttccctcatacggggcatttggaatcgataaccttattcactacaaaataactcggttattcggtacaatatccacccaaaataaaagcgacaggaagttgcttgctcttcatcaacaagggggtattatggttgctgttcgtggttctcatttgttaaatccgcaggattttgtgattgaacaatggtgcactggcttaaaactagcagaacaaacagaaaaaagtttgancgatgcgtggtattacgcacgtgatttaatgaatgcctaccccgatgaaatgaagaatgcgaccttgatgctgcagtctggcgtggaaatggtagaaattttgcacgaacttaatatggatgcggaaacattgcttactgccatgttgtttcctattgttgcaaataaattaacagactgggaaagtctaaaagaaaaatttggtgcgaaaattactaaattacttaaaggcgtgttggagatggataatattcgccaacttaatgccagtcattccgctaacgctctgcaagtggataatgttcgccgtatgttgttggcgatggtggacgatttccgctgcgtgatcattaaacttgccgaacgtattactttcttgcgtgatgcagagcatcgttgtgcagaggaagacaaagtccttgccgtcaaagaatgttcttatatttatgcccctcttgccaatcgtcttggaattggtcagctgaaatgggagttagaagattactgcttccgttatcttcatcctgaacaatatcgcgctattgctaaattattgcaggaacgtcgtcttgatcgtgaacattacattgctgatttcgtcagtgagttgagcggttatttacgtgaaaatatcgagcaagtggaagtctatggtcgtccgaaacatatttacagcatttggcgtaaaatgcagaaaaagcatcttgaattcagcggtttatatgacgtaagagcggtcagaattatcgtgcaaaaattacaagattgttacaccgcacttgggattgttcatactcaatttaaacacttacccaaagaatttgacgattatgtggcgaacccgaaaccgaacggttatcaatctattcatactgttgttttaggtaaaggtggcaagccaattgaagtgcaaattcgaacccaacaaatgcatgatgatgcagagttaggtatggcggcacactggaaatataaagaaggcaatacaggcagtatgtctgcctatgaagaaaaaattgcgtggttgcgtaaattgttagcttggcaagatgatattacggattcaggcgaagtgctggcagagttgcgtancaagtgtttgatgatcgtgtatatgtgtttacgccaaagggcgaagtggtggatttgccaacgggatctacaccattagattttgcttatgccattcatagtgaaattggtcatcgctgtatcggggcaaaagtggcggggcgtattgtgccatttacctatcagctacaaatgggcgatcaaattgatattattacccagaaaaatccgaacccgagccgtgactggctaaacccaaatttaggatttactcacaccgcaaaatctcgagccaaaattcaagcgtggtttaaaaaacaagatcgcgataaaaatattccagcgggtaaagaattactcgataatgaactcgcgcttttgaatttaagtattaagcaagtggaaccttatgcgttaccacgctataacttgaaaaatttggacgatctttatgcgggcattggcagtggtgatattcgtttaaataacttaatccatttcttgcaaagtaaattgattaaagtgactgctgaagaggctgatcaagaaattttacgtcatgttgctaacaaaagtgcggtcaattctcagcagaaatctgaaaagaacaatggctgtgtgattgtggagggtgtggacaatcttatgcatcatattgcgcgttgctgccagccgataccaggcgatgcgattgttggctatattacaatgggacgtggtatttctattcaccgagcggattgtgaacaattcttagatttgcaagcggctcatccagaacgcgtagtggaatcaatttggggcgaaaattacgcaagtggtttccatattaatatccgtattgtggcaggcgatcgcaatggcttattgcgtgatattacaacggttctagcaaatgaaaaaattagcgtattaggggtctcaagccgtgctgataccaaaaaacagcttgctactattgatatggaaattgaacttcataatgttgaaagtttgagtaaaatattggctcgattagcaaaattagatgatgttatcgaagcgaagcgtttataaaaataggaaaawttatgtataaaacgacggggctaacccatttaatcaactccactaaatattcattacaaggcttaaaaagtgcgtttaaaaatgaaacggcttttcgccacgaatgttttttagcctgcattttaattcctcttactttctttttaggcgaaacaaaaattgaaattatattgatgatttcttctgttttgcttgtgatggcgttagaacttttaaacagtgcggtagagacagttgttgatcgcattggtacagaacgccacgaactttcaggacgtgcgaaagatcaaggttctgcatcggtatttattgccctttgtattgtcggtatcgtttggggcggaattttattcttctaaccctccaaaagtgcggtaagtttttaccgcatttttgatttatccaatcacgtcaaaatcatttataaaaataaggaaaaatatgaccgcacttttaaaaattggtctggtgtctgtttctgatcgcgcatcagcaggcgtgtatcaagatcaaggtatcccagaattacaggcttggttagaacaagcgttagtagatcctttccatttagaaacaagattaatccccgatgaacagccagttattgaacaaaccttaaaagagctggtggatgaacaaggttgccatttagtgctgacaactggtggaactgggccagcaaaacgcgatgtaacgcctgatgcaacccttgcggtagcggatcgagaaatgccaggttttggcgaacaaatgcgtcaagtgagtttgcattttgtgcctaccgcaattttatctcgccaagtgggtgtaattcgtaaggaaagcctgattttaaatcttcctgggcaacctaaagcgattaaagaaaccttagagggcgtaaaagataaagaaggaaatgtgcttgtaaaaggcatttttagcgcagtgccttattgtttgcaactgattaacggcttatatattgataccaagcctgaaatcatcgaaagtttccgtcctaaatctgcaagacgcgaaaatctggagaaatagcatgaaaaaaatcgaagcaatgattaaaccctttaaattagacgatgtgcgagaaagtctttcagatattggtatttcaggtatgacaatcacagaagtacgcggatttggtcgtcaaaaaggtcatacagaactttatcgtggtgcggaatatatggtggattttctgccgaaagtgaaattggaagtggtagttcctgatgagcttgtggatcaatgtattgaagcgattattgaaacggcacaaacaggtaaaatcggtgacggcaaaatttttgtttatcacgttgagagagccatccgcattcgcacgggcgaagaaaacgaggatgcgatttagtgcaaaataatttaaatttacaccgcactttgcttggcattgctgcggtgattattatcttagctggcgtaaaattggcggcagaaatcgtggtgccattcttgctatcactctttatcgcgataatttgttcgccgataattaaggcgatgacccaacgccgcgtcccgcattggttagccattactttgctttttgtcttgatttctttggtatttttcttcttagtcgggttgattaacagcacggcaagagaatttacccaatctattccacaatataaagttttgctttcacaacgcgtgagtgatttaactggattgttgcaacgtttcaatctgcctttcacgctttcgcgtgaaactatccaagaaaattttgacccaagcatcattatgaattttgtaagccgagtattgctgaatttctctggtgtagtgagtaatgtgtttgttttagtgttggtcgtgatttttatgcttgccgaagcaccaacgatgaaacataaatttgcaatggtgattagttcaacccctcatgacgtagccaaagaagaacgccatattgatcgcgttttacaaggtgtaattggttatcttggcatcaaaagcatcacgagtttattgactggtgttggagtgtttattttgttggaagcctgtagggttcaatatgcgattttgtgggcaaccttgagtttcttgctgaattatattcccaatattggttctatcatcgcggctattccgattattgtgcaagccttattactgaatggttttggcattggctttggcgtggcaatcggtgttattgcgattaatatggttgtcggtaacattattgaacctaaaatgatggggcaacgattagggctttcaactttagtggtgtttctttcattactgttttggggatggctgcttggaaccgtgggaatgctactgtctgttcctttgacgatggcattaaaaattgccttggagtccagtcccaatacagcgaaatatgcctgtctattaggagatgtcgaagatttcaaatagattttagagataaaagtgcggtgaattttcaccgcattttttatgataagtcttgcggatcgacgtccaaaattaaccgcacttggctgtttttttctagttcggcttgttgatattctcttaatgctttttgcaacgtcattcttgatggatgctgcaataataactgccagcgatattgccccgcttttttgctgaacggtgcaggcattgggccaagcatttgtaatcccgtaatttgcttcgattgaaaaaaatctgcaatttggcttaagcaattttctgcaagatcagaatgtcgagcctgtgctttgattaacgcctgaaaagtaaaaggcggcaatcccattgaatggcgtaattgtaaggtttcttttgcaaaagcttggtagccatttgccaataaagtggtaagcaaaggatgatctggataatgtgtttgtagcaccacttcaccttgtttatcggcacgtcctgcacgtccagcaacctgaatataaagttgagctaaacgttcttctgcacgaaaatccagtgaaaataatgcactatctacattcactaaggcaacgagagtaacattcgggaaatgatgtcctttcgcaagcatttgtgtgccaatcaaaatttgacttttgccttgttgaatatcttctaaataaccttccaattttcctttacgcgaagtgctatcgcggtcgattcgagccacagaataatgaggaaatagagttttcaaggtttcttctaattgttctgtgccgagacctgtagtgactaaatgagtcgagccacaatcaccacattgtcgaggaatagttttctgtgcaccacaatgatgacaacgcaatacattttgatgctgatgataggtataaggtttttcacaatgcgggcattgtgcgatccaaccacattcatggcaaagcaatacgggcgcaaagccacgacgattcaagaaaagcaacacttgattgcctttttcgaggtgggctttcattcgttccaacaagggttttgaaagcccgttttgtatattttgatttttcaaatcaataacgaaatgacgaagtgcggtagaatttcccgctctttttgataaaactaaatgttggtatttgccgttttgtacattattaatactttctaaacttggcgtagcagaacccattaatactgaaatgttcagtttttgagccagtacaatcgccaagtctcgcgcgtgataacgccaactgtcttgctgtttgtaagacgaatcgtgttcctcgtccaaaataattgcaccaagattagaaaattgcgtgaacaatgccgatctagtgccaatcacaatagcactttgtccagagcgggcgcgatcccatacataaagccgttgcgtatcggttaaattagaatgcagcacatcaatttctacattgaaacgcactttgaaacgttgcaccgtttgtggtgttagcccgatttcgggtacaagcactaatacttgtttgcccgattttaaaatttcttcaatatattgcagataaatttctgttttgcctgaaccagtcacgccatcgagcagccatacattgaaaccagaatggaagagcagttggctgaaggctaaggcttgctgcttatttaaggttaaacgattttcagcattaacaattgggttattgcctaatctttgttgccagcttaggggatttgtttggatagtaatttcttcaataaaccctttggcttttaaggctgaccaaatggcagaggaaaaatcattattgcctttttcaagatcagtttcagataagtattgtagggcttcagcttgctttttcgagcgttttaattcgccttgtttaagggcatttttccccgcatccgtaattcgccaaaaagtgcggtcattttttaccgcactttcgccgttacgcaatttcacaggtaaggcttgaaataacacatcgcctaatcccgcttgataataatttgctgcccaatgaagccaatcccaataaatgggcgtaaaaagtggggctaaatccaatggttgaagaatagccttgagtttatcctctggcacgtccgattttgtcggaaaatcagccacaatggcgacacgtttttgagtgccaaaaggcacaagaacacgcataccgatttgtaatgaaacatcatcggggacgaaataatcaaataagcgaggaagcggcacagccagtgccactcggacaattttcataatcaaccttggaaaaaatttgccctattatacgagaaaaattggtataatcgccgccaattttttcacgaacaagatttttatgacacaaacttttgccgatcaaaaacgtaaaaccgttgaaaccgcagaatttaccgaagatggccgctataaacgcaaagtccgtagttttgttctccgcacaggtcgtttgagcgaatttcaaagaaatatgatgaatgataactggggaacacttggtttagattaccaaacggaaccttttgattttgcgaagatttatggcaatgataatccagttgtattagaaattggctttggaatgggaaaatcgctcgtggatatggcttttgctaatcctgacaaaaattaccttggcattgaagttcatactcctggcgttggtgcttgtattgcttatgcagtggaaaaaggcgtaacgaatttacgcgtgatttgtcatgatgcaacggaaattttacgtgacagtattgcagatggtgcgcttggcggtttgcagttatttttccccgatccttggcataaagcaaaacatcataaacgtcgtattgttcaaccgcactttgtgacacaagttatacaaaaattaggtgaaaatggttttatccatatggcgacagactgggaaaattatgcagagcaaatgctagaagtattaagcgcaaacaccgatttagtgaacacctcgaaaaatggtgattatattccaagaccagattttagacctttaactaaatttgaagccagaggttacaaacttggacatggtgtttgggatttatattttgtgaagaaataaatcagttttaggcaaactcgatgcctaattgatgaatttaatatagaatatgccttcaaatataaccttaataggagaaatacaatgtctaaatcttacaatcaacgccaacgcaaaaaacttcatctcgcggaatttcaagaactgggttttcttgtaaatttccaatttgcagaaggcactgcgattgaaactgtagatgaaaccgttgatcgttttattaacgaagtgattcaaccaaatggattagcttatgaaggtagcggttatttacattgggaaggtttagtttgcctagaaaaaattggcaaatgcgatgaaagccatcgtgaaactgtgaaaaaatggttagaaacaaatggtttgcaacaaattgaagtaagcgaattatttgatatttggtgggaatatccaacaaaagtagaataatctaaattgaaaacagcatagtcaaaattgctatgctgttttgttttaatcccttgcaaaattcattaaaccttagattttttgatctataacaaataaagttcaaataattgaaaaactacctattttgggttgttttcattcattcatcgtaaacacataatccgttgcctacagaagcattcagaaatatttgaaagacattatgaccgttgaaaatttacctcgcagacaatttttacgcggtaaattttcaacattgagctgtttagaaaataatcaaaaacagaattttgtgggtattaggccgccttggtctgtggaaaattctatttttgtagcacggtgtacgcgctgtggcgactgtctttctgtctgtgaaaccaatattttggtaaagggcgatgctggttttcctgaagtgcgttttgataatggcgaatgtactttttgtgggaaatgtgtagatgcctgtaaacagcctattttttatccgcgtgaccagttaccttggtcacataaaatcgacattagcgtagttgtttaacattgcaccgtattgaatgccgaacttgccaagataattgtccagctaatgcgattcgtttcaaattacaaatgggtggcgtagcacaacctttagttaatttcgatgcttgtaatggctgtggggcttgtgtacaaggctgccccgtgaatgcaataacaatgaatgatctaaaacaaaatgaataatacaaatttaatattagaaaatgcgagagattggcacgtngttggattgatcgtgcaaggtaatccaaaaaaattatcagcaattcaaaccgcacttttagcgattgagcatactgaaattccgactcttgatgaaaaacttggaaaatttgtggtggtaatgcaatcgaacgatcagcatctcttgcttgaaaaaatggaaagtgtgaaagatatcgacggtgtgattaatgtatcgttggtgtatcacgagcaagatgaacaaaataaatagttttaaaatcaaacgtttaacgtgggggaaaacgcgatgaatttaagtcgtcgagactttatgaaagccaatgcggctatggcagccgcaacggcagcggggctaaccatcccagtcaaaaatgtggttgcggctgaatccgaaattaaatgggacaaagcagtatgtcgtttctgtggtaccggttgtgcagtattagttggtactaaagatggacgtgttgtggcatctcaaggcgatcctgatgcagaagtaaaccgtggtttaaactgtattaaaggttatttcttgccaaaaattatgtacggtaaagaccgtttaacgcagccgcttttacgtatgacaaacggaaaatttgataagaacggcgattttncgccagtttcttgggattttgccgttcaaaacaatggctgaaaaattcaaagaagcgttcaaaaagaacggtcaaaatgcagtaggtatgtttagttctggtcagtctaccatttgggaaggctatgcaaagaacaaactttggaaagcaggttttcgttctaacaacgtagacccgaatgcgcgtcactgtatggcatctgcagcggttgcgtttatgcgcaccttcggtatggatgaacctatgggttgttataacgacattgaacaggcagatgcttttgttctttggggctcaaatatggcggaaatgcacccaattttgtggtcgcgtattactgatcgccgtatttctaatcctgatgttcgtgtcactgtactttctacttacgaacatcgtagttttgaacttgccgatcacggtttgatatttacaccgcaaactgatttggcaattatgaactacatcatcaattatcttattcaaaataatgcgattaattgggattttgttaataaacataccaaatttaaacgcggagaaacgaatattggctatggtttgcgtccagagcatccattagaaaaagacacgaatcgtaaaacagctgggaaaatgcacgattcttcttttgaagaattaaagcaacttgtatcagaatatacagtggaaaaagtatcgaaaatgtctgggttagataaagtccagttagaaactttagcgaaactttatgctgatccaacgaagaaagtggtttcctactggacaatgggctttaaccaacatacacgtggtgtgtgggtaaaccaattaatctacaatattcatttacttactggaaaaatttcaatcccaggttgtgggccattttcattaactggtcagccttctgcttgtggtacggcgcgtgaagtaggttcattccctcatcgtttacctgccgacttagtggtaactaatccgaaacaccgtgaaattgctgaacgtatttggaaattaccaaaaggtacggtttctgaaaaagtggggttacacacaattgcacaagaccgtgcaatgaatgatggcgaaatgaatgtgttatggcaaatgtgtaacaataatatgcaagcagggccaaacattaatcaagagcgtttgccaggctggcgtaaagaaggcaacttcgtgattgtttcagatccttatccaactgtatccgcactttctgctgacttaattcttccaacggcaatgtgggtggaaaaagaaggggcttacggcaatgcagaacgtcgtacccaattctggcgtcagcaagtcaaagcaccgggcgaagcaaaatcagacttatggcaattaatggagttcgcaaaatacttcacgacggatgaaatgtggacagaagacttacttgcacaaatgcctgaatatagaggtaaaactttatatgaagtgcttttcaaaaatggtcaagtagataaattcccattgagcgaacttgctgaaggccaattaaacgatgaatcagaatattttggttactacgttcacaaaggtttatttgaagaatacgctgaatttggtcgcggtcacggtcacgatttagctccatttgatatgtatcataaagcgcgtggtttacgttggccagttgtggagggtaaagaaaccttatggcgttaccgtgaaggctatgatccgtatgttaaagaaggggaaggcgtggctttctacggttatcctgataagaaagcgattattcttgcggtgccttatgaaccaccagctgagtctcccgataatgaatacgatttatggttatcaacaggtcgtgttcttgaacattggcatacggggacaatgacacgccgtgtaccagaattgcatcgagcatttccaaataatttagtatggatgcacccattagatgcacaagcacgtggtttacgtcatggcgataaaattaagatttcatctcgtcgaggcgaaatgatttcttatttagatactcgcggacgtaataaaccacctcgtggcttagtatttaccactttctttgatgcaggtcagcttgcaaatagcttaacactagatgcgacagacccaatttcaaaagaaaccgacttcaaaaaatgtgcggtaaaagtggaaaaggctgcgtaaaaaccatgtaaaaatcaaccgcactttattttctcccatcaataaaagaggaagatgaaagtgcggttaaaatctaaaaagaaaatgaagaaacccgcacttaatcctgaacgtagaaaatttcttaaagaagcaacccgtactgcgggtggtttagctggcgttgggattttgttgggattgcagcaaaatcaaagtcttgcgcgcgaaggtgtgccattacgccctccatttgctttgcaagatgcgaaagcgttttctgccgcttgtattcgttgcggacaatgtgttcaagcctgtccttatgacatgctgcatttagcctctttattatcgccagtagaagcgggaacgccgtattttattgcgcgtgataaaccttgtgaaatgtgtcctgatattccttgcgcaaaagcctgtcctagtggtgcattagatcgtcaagcaacagatattaatgaatcgcgtatggggctgtcagtactgttagatcacgaaacttgcttaaattatcaaggattacgttgtgatgtttgttatcgagtttgtccattaatcgataaagcgattacattggaaacacaacataatccacgttctgataagcatgccttatttattccaacagtacattctgatgcctgcacgggatgtggaaaatgtgagcaagcttgtgtgttagaagaagcagcgattaagattttaccaatggatctggcaaaaggtatgttaggtaaacattatcgtttaggttgggaagaaaaagcgaaagctggccattctcttgcacctaaagatatgatttcattgccaactcgaacaccagaaggaacaactgtaattcctgaaccagcagaacccgtgcttgcgcctattttagggagtggcaaataatggcaaatgcaccaaaatttgcagggaaagaatcgcgcgaaaaatggggctggtggtatgcaaaccgctttttgttttggcgtcgattaagccaacttagcantcttgcgatgtttttgagtggcccttattttggcgtgtggattttaaaaggtaattatagtggtagtttattactcgatactattccactaagtgatcctctaattaccgctgaaagcttggctgcaagacatttaccagatgctctcactttaattggtgctgcaattattgtgttattttacgcagtacttggtagtaaagtgttttgtggttgggtatgcccactaaatgttgtgactgactgtgcagcgtggcttcgccgtaagttaggcattcgccaaacagcaaaaatttcgcgcggtttacgttatggtattcttgtgcttattttactaggcagtagtgtcagcggaatgttgctttgggagtgggttaatccagtggctgctcttggtcgcgcctttgtatttggttttggtgcaacaggctggttattacttgttatttttctttttgatttattgattgctgaacacggctggtgtggacatctttgcccaattggtgctgcttatggtgtgattggtgcaaaaagtttaatccgtattaaagtgattgatcgcgctaaatgcgataattgtatggattgttacaatgtttgtcccgaagcccaagtgttacgttcgcctttacacggaaaaaaagacgaaagcctactagtgctttccaaagattgcatcagctgcggacgttgtattgacgtttgcgctgaaaaagtttttaaattttcgaccagattcgatcattcaggggagtgattaatatgactaaacaggtatctaaaattttagcgggattatttaccgcactttttgctggctcactgatggcatctgatgcaccagcagtgggaaaagatttaactcaagcggcagaaaatattccacccgcatttcataatgcaccgcgtcaaggcgaattacccgcattgaactatgtaaatcagcctccaatggttccacatagtgtggcaaactatcaagtgacaaaaaatgtaaatcaatgtttaaattgccacagcccagaaaattctcgtttgagcggtgcaactcgaatcagcccaactcactttatggatcgtgatggaaaagtaggttcaagttcatcgccacgtcgttatttctgtttacaatgtcacgtttctcaagcaaacgtagatccgattgttccaaatgatttcaaaccgatgaaaggttacggaaactaatttaagaggtctatatgtctgagaaaaaaccaaatatcttaaagcgtttctggcaatggtttagaaaaccaagccgtatggcgataggtacaattattatcttatcggctattggcggtattctttcttgggttggttttaactatggtttagaaaaaaccaacactgaacagttctgtgcaagctgccatatgcaagatgcttatccagaatatttacatagcgtgcattatcaaactcgtactggtgtgggggcaagttgtccagattgtcacgtaccacacgaatttggtgcaaaaatgaaacgtaaaattattgcagctaaagaagtatatgcgcactatactggaaaagtggataccttagaaaaattcaatgcacatcgtttagaaatggctcaaaatgaatgggcgcgtatgaaagctaacgattctaaagaatgtcgtaattgccataatgtagatcgtatgaccttcaatgatcaacgttctgtggcggcacgtatgcaccaaaaaatgaaaactgaaggtaaaacttgtatcgactgtcacaaaggtattgcacaccaattacctgatatgagtggcgttgagtcaggcttcaaagacgagaagtgattttctaaaaataggctgaaaaaatatcgcacttttttcagtctattataaatttgggtagtttataaaaaaatctgcactttaattcgctgatttattcagcctttaaggtgcagattaattatattttctaaagtgcggttaatttttagattatttttagcctaagattttatctaactcttggctaacttcttccactttttgtgtaccgtctaaacggaaatattgagtattccccgctttcgcttctgcttggtaataatcaattaatgggctagtttgtttatgatatacggctaaacgatctaatacagtttctggtttatcgtctgcacgaataattaaatcttcgcctgttacatcatccttaccttccacttttggtggattataaacgatatggtaagaacgaccagacgcttggtgtacgcgacggccactcatacgttcaacaatcacttcgtctggcacatcaaattctaaaacaaagtcaattttaacacctgaatctttcagtgcatccgcttgtggaatagtacgagggaaaccatctaacaagaaaccatttgtgcagtcagcttgagcaatacgatcttttacaagggcaacggttaattcatctggcactaatttaccttcatccattaatgctttagcttgtttgccaagttcagtccccgctttgattgcagcacggaacatatcaccagttgaaatttgcgggataccaaatttgttcataataaattgtgcttgagtgcctttacctgcacccggtgcacctaaaagaataattttcataaaaaatctccattaatacaaaacgtgattaagatactgataaagcatagtgcggtcaaattttttataatttttaccgcacttttatactgagctggtcttattattttcttgcttcaaaggtgctacccaaaataaacaaagcatgccgggaatcgctaaaaataaacaaaaccaaaaatactgataataccccactgctcccacaacataaccagaaagtatacctaaaactttacttggcaaagctgaaaggcttgtaaaaagtgcaagctgtgttgcagtataaagaggattactctcacgcgccataaaagccacaaaagcagcggtaccaagtccaacgccgatatattctgctgcaatcacaacacctagtttccataactcggcagatgtaataacatcaaaatgtccaaaagcagccaaccaaataaacccaccaattgttaccatttgtacaagcccaaatagccacaatgcacgattaatacccagttttagcattatcataccaccagcaagcccagataaaatgcttgaccaaagtgcggtactttttacaacaatagcaatatcctctttgctaaatcccatgtcataaataaatttggtttgtaacgttgtggcaaaagaatccccgaacttatacaaaaacaaaaatagtaaaaaaccgatagcctgaatgacgcccttacgctggaaaaattcttgtaatggaatccaaaatgcttgatagaacggctgattagtttgctgcatgtctatttttggctctttggctaaaaatagtgtcatgaagatgcctgctaacatacaaagtgcggtccataaaaagacggtttcccaaggataaatcgccgccaaatatagcgataatccccctggaattaatcccgcaattcgataagcattaatatgaatagtgtttcctaaacctaattcatgatcactcaaaatttcacgacgatacgcatccaacacgatatcttgtgtagctgaaaaaaaggcgataagcaacgcaatatttgctactgtacccagttgtgtgagcggatcaaacaggctaatgatgtaaagtaaaatcaataatgccacttgtgaaagcaacatccagctacgacgacgccctaaaaaactcgggaaataacgatctaataatggtgcccacaaaaatttcaatccataaggcaacatcacacccgttactgcaccaataagctcaattgaaagatgtttatctgtcagccaaacaggcaacatttgcgacaatacaaataatggcaaaccagaattaaaacctgtgaaggcgcaaattaacatcttgcgcgtaaaaatttgagaagaaagggaatttgacataaagtgcggttaattttagttgtattttagaaatttcgcctttcaattaaaggatttttgtaaaaattaggggatttttaatcattcccctaatgtttagcattcttcttcctaaaaaagaaaaacaaatattagagaatattaatctctatacccttttggattatttttctgccagttccacgtgtcttgcatcattttttcaagaccacgttctgccacccaaccaagctcttttgccgctaaactaggatcagaatagcaagtggcaatatcgccagagcggcgttctacaagtttatatgcaattgtaatattgttggctttttcaaaggcttttaccatatctaatacggaataaccatggcccgtaccaaggttataaatatgtaagccagcgtcattttcatgacgttgaagcgcttttaaatgccccacagctaaatccactacatgaatataatcacgcacacctgttccatcatgagtgtcgtaatcactaccaaatacagaaagttgtgctaatttaccgatagcaacttggctaatataaggtaataaattatttggaataccatttggatcttcaccaatcaagccactttcatgcgccccaactggattaaaataacgcaagatagtcatgctaaattttggttccgcttttgctgtatcgcgtaaaatctgctcaaccatatatttagatgtaccataagggttggttgtaccgccgacttcacaatcctctgtaattggrataatttttggntcgccgtaaaccgttgcagatgagctaaatacaaagttccaaacacctgcttttttcatttcttgaattaatacaagggtgccagcgacattgttcatgtaatattctgtcggcttttgaacactttcccctacggcttttaaccctgcaaagtgaataaccgagttaatctcattttctgcaaaaattttttgtaacaaagcacgatctaaaatatcgccttcataaaactttgcttctttgcctgtaatttgttttacgcgctcaagggattttggcgatgaattgcaaagattatctaataccaccacctctttgccaacatttaataattctacaactgtgtgagaaccgatataaccagcgccacccgtcactaaaatggccataatgatttccttgttaattattgagactaaaaaattatatcactattttgtgtggtaagaatggtgattttcaataaaataaaaaacctgttgctaaaaagtattgttgtagcgagtgagataacctctcatatttagggctatgtccattagttgtgtgatataaggttatctaatcccattttcttgattttaaggcgtgttttatatcattaggtaaacgtaatatatcccagatcaaccgaaaaatcagattttggtaaattcttggtttggaatatataccaatttttttatatacaaacttcggcggaattaaaatatcttgtgtgtaatttttcttttcttcgagaataaaagtaattgggttattcagtggtgataaaggaaaataattacatagaggactttctggcgaaatgcaataaatatttactccataatgtttttgtaaaaaataaagtgcatttaaatcatattccatagaatggatatcgctttgacttttattttgtgaaaaagaaggtaataatttaataatattttctttttgatgatgaaatgcgtaaggattccctttttcttgataaaaatcaatacctgttaaataaagatctttataacccattacagttgccactgcacacatataaacgcctgatgtaattctcttattttcatataattcgttatattgtaaataggcatcaaaggcgggtagcttgtttaaataataatgtccaatatcaacttgtgttagtaatttttgtacatttttaattttctttaattctgaatctcctaaattgacaaaagatgataaaataatatcagcatattcatattcattatttttaattaattgcataaaagtatagtattgctcaaaaattgtagaacaattaaaaaatactttttttattttcttgccaagaaaataatgatcttcaaaataaaattgattgcaacggaaaacatcataatctttaggtaataaactatagtcaattgattttaaacttgttccattacctgcaataatgacagactttgattgattgattgattgattgattgattgattgattgattgattgattgattgattgattgattgattgattgattgattgattgattgattgattgattgattgattgattgattgattgattgattgacatattgtaccgttcattgaataaaatagaagttatccctnaaaaatnataaacattatatagatttatagaactttttactaaacgttgattataccttcctaaaantattatctaatatcagttgtacgatctccgttgtatcttagcaagagaaatttaaaaatgcttttcttgttccattcggatagaaacctaattgcttgttttttctaccaaacaagcgtaaacttaccaacagtttttagtcggggtgccgaaaggctgagatgatacccgtgaacctgaaacagttagcactgacgtaggaaactaatatgccaaaaaatccattttcttttcattccatttcttatcctttcttttttattacgcactccctttaatcattgaggcgagcaatggtgcgtattcaagatttgagtcttgcctttaatgggcaaacgttatttgagcatcttaatttaaccctgttgccgaacgaatgggtgagcttgttgggcagttcaggcgtgggaaaatcgacacttttgcgactactggcgggcattgaaacgcaaggcatggtgcaggggaaaatcctatttgaaccgaaagttcgcattgcgtggttgccacaaaaagagacactttatccgtggttgtcaattgtcgataacgtgcagttgcaagcggtcttatttgggcgaaaatctgtaaaaaccactgaaaaagctaaaatgttgcttgaaaaagtgggaatggcagcacattggcacaagccttgttcgcagctttcgggcgggcaaaaacagcgggttgccttggcacgcaccttaatgcaagaggtggatttgattttgcttgatgagcctttttccgctcttgatgccatcagtcgccatcaacttcaagatttagcctttgaactgctcgaagataaatcagtgctgctcgtgacccacgatccacaagaggcattacggctaagtcagcgtatttttgtgttgcgttcgcctgaaactcatcaaacagcattatcggcggtgattctgcccgaaggtaacgccccgcgtgagttgcatcaagccaatttatggacgttgcagcaacaattattgcaggaattagggggcgaacaatgaaaattcgcctacttaaaccgcttttaattgttggcgtgttgttgatgatctggcaaatggtcgcaaccttgggcagcttcccacactacatttttccctcaccgcaagctgtaaggcagcagttattcacacacgctgaactgctttggcagcatacgcaagtcacgttgttagaaatctgcttagggctgttgttaggctttctatttgggttgatttcggcgttgttgctctcattttctcgtcaaatttctgccgtcttattgccgattttggtcatttcgcaagcgattcccgtgtttgctattgcgccgttgttggtgttgtggtttggctatggaatggcatccaaaattgtgatgtcggtgctgattatctacttccccgtcacggcagcttgttatgatggactacgcaacaccccacaagcgtggctcgatttggcgaaaacctttaacatttcccccttgcgtttattgcttaaagtgcgattacctgcggctttgcctgcttttgcttcgggcttgcgaattgccgtttcggtcgccccgattggtgcggtggtgggcgaatgggtaggttcatctgaaggcttggggtatttgatgattcacgccaatgcccgaatgcaagtcgatttaatgtttgccgccttactgattttagtgtcaatttcactctgtttatatttcagcattgattggctattacaccgttttatttggtctgtttaacttttcattaaaggagaaaaaatgaagacaatcatccgttatttcagctttgtaatggggctaatgctcactcttcctagctttgcaaaagagaaaatcagcataatgctagattggtatgtaaaccccgatcatgcagccatcattgtggctcaacaaaaaggcttttttgaaaaaaataacttggaggttgaaattatcgaacctgctgatcctgcattaccgccgaaattagctgcggcagaaaaagttgatttagccgtgagttatcagcctcagctttatcaacaagtggcagaaggcttgcctttagtgcgagtgggttcactgatttcaaatccattaaatagcgtagtggtactaaaaaagagcaatttgaaaagccttgctgatttaaaaggtaaaaaagtggggtattctgtcagcggttttgaagatggattacttgatacaatgcttcattctattggtttaagcaataaagatgtggaattagtgaatgtaaattggtcgctttcgccctctcttttaactggacaagtggatgctgtgattggtgcatttcgtaattttgaactcaatcagcttgctttagaaaagcaagaaggtatcgcattcttccctgaacaatatggcgtgcctgcttatgatgagttgattttagttgctaataaaaacagcgtaacagataaaaaaacatcggcatttttgaccgcacttgaacaagccacaagctatctacaagctcaccccaatgaagcgtggcaagcctttgtcagctataaaccaaacgaactcaacacgccattaaaccaactggcgtggaaagacacgctcccctttttagccaataaacctcgccaattagacgctaaacgttatcaacaaatggcagaatttatgcaacaaaaaggcttaattccaaaagccttagccttgaaagaatatgcggtagaaattgaataaggaaaaaagatgattgaacaactcattcaacaagctcagccttattggcaacaatatattgaacacgaatttgtgcaacagctcgcaaaaggtacgctaccaaaagcttgttttcagcattatttgaagcaggattatctctatctttttcattacagccgagcctttgccttaggtgtattcaaggcaaaaaatttcgctgaaatggaaacacctcgtaaaaccttagagattctttgccaagaaattcaactacatttaaattattgccgtgagtggggaattagtgagcaagagatttttaccacccaagagagtgccgcttgcattgcttatactcgctatttgcttgattgcggcatgacgggcagtttggctgagctttatgcagctgtaaccccttgtgctttgggttacgctcaagttgctcgttacattactcagcattatcctcgcttaccgaacaatccttatcaaacgtggattgacacctatgcgagtgaggaatttcaacaagccgcccaagaaaccgttgattttcttaccgcactttgcaaaccactaaacccaagccagcttgctgagattcaacagattttcaccaccgcaactagaatggaaattgcgttttggcaaatggggttggatttggcttaggcttagattggcgattagacgaataactttatttatctccaaacggataaatttattgcgattttctacctcctctttgagaaaagaggggtagaaaaattatcttattctaatcttgctataagctaatgctataacaaaaaatgcggcttgcagaagaataatacaagcacctgttgaggcatcaaaatgatagctcaatattacgccaattaagcttgatgcaatggaacttgcaatagcaacccataacattttatcaaaagatttagtaagagtaagtgcggtaattcctggtgcaattaacattgccaccaccaaaataacacctaccacttgcatcgtgcttacaatggttaaagcaagtagaattaataaaccataatgtaaaattttaggagaaagtcctgcaacacgggcgtgacttggatcaaaacaataaagcagaaagtctttacgtttaaagacaatcagacaaaaaattatcgcagaaatgaccgcactttgaataagttcttgatgacttacacccaacacattaccaaacaaaatatgggttaaatgctcttctgtttgaattttggtaaacataacaagaccaatggcaaacattccagaaaatacaatgcccattgcggtatcttcttttatacggctattttctttcaaatatcccacaccaagcgaacaaaaaatacccgagaaaaatgcaccaatggctaaaggaattcctgccaaataagcaagtacaataccaggtaatacagcgtgagaaattgcatcacccattaatgaccaacctttcaagactaaatagcaagaaagtaacgcacagataatcgaaacaatcaatgcggtcaataaggcattttgcataaactcaaattgtagcggttctaaaagccaatcaaacattttctaccgcctttttattacgagttaataagccatattttggtgaaaataagaaagcgactaaaaacaataatgtttgcaatgtcacaatcacaccgcctgtggcaccatctaaataatagctaatataaacaccaacaaaacttgtcaccgcccctaaaataatagcgatgattgacaaggttttgaatttatctgtgagtaaatatgctgtcgcacctggggtaacgaccatcgcaatcactaaaatcgcgcctacagtttgcaaggcagcaaccacacaagcactcaataatgtgaaaaataaaattttataaaataatggagaaagaccgactgtaatcgcttgtgtttcatcaaaaaaaatcagcagtaaatccttccaaaataataaaagcaatactaaacaaacaccgatgataattgccacttgataaatatcttcatcagcaatgcctaaaatattacctaaaatgatattttgcacatttactgcggttggatttaaagaaacgattaacaaacctaatgcaaagaaagtactgaaaataaacccgataacggcatcttctttcagtttagaaatagatttaatccaaagaatggaaagtgcggctaaaattccggcaaaaaatgcaccaagtgcataaggcaacgcaaaagcataggcaattgcaacaccgggtacgacagaatgggaaagtgcatcaccaattagagaccagcctttaagcattaaatatgaagacaaaaaagcacaaatgccacccactgcggtactcaaaatcatcgccttgagcatataatcataggaaaaaggttcaagcaataaatctaacattacctaatccctcttatttttaactgcacttttataagggcaatcttcaaaatgacaattttgtgttgttggcgcaggtggatcttgcttagtttcgccatagaatacaacggctttttcatcatctgttaagacggtaacagaacgtttatcttcatcattatgtaaattttcgcccaataatttaatatgacgcaacaccccaccaaatacaatttccaaattatgttggttaaaggtgtcttctgtttttcctgcggcgatgactgtgcgattaatcatgaccacttgatcacaaaaatcaggaacagaacctaagttatgggttgaaacaagaatcagatgaccttcttctcgaagctgttgaagaagatcaacaatggcattttcagttttcacatcaacgccagtgaaaggttcatccaataaaataattggactttgttgtgctaaagcgcgggccaaaaacacgcgttttttctgcccgccagataactcgccaatttgacgatgcgcaagatgctcaatatttactcgctgcatcgcctcttgaactttttgtttatcaatcgctttggggatacgaagaaaattcatatacccataacgtcccatcatcacgacatcatacactgacaccggaaattgccagtccacttcttctgattgtggcacataagcaaccaaattacgtttcagtgcttgggaaattggcaaatcacaaagtttaatttcgccttgttgtggctttacaagccccattatgcttttaaataatgtggacttgccacttccattcacgccaactaacgcacaaatagttccactattgagtgagaacgtcatattgtgaatagcagtatgaccattgttgtaacgaacagttacatcattaacccaaattgatgtcgagaaagagtccattattttccgaatcctttaacaatagttgatacagtgacgttaagcaaatcaatataagttggcacagggccgtttttcgcagaaagtgaatcaacgtacaatacgccaccgtattttgcaccactttctttagctacttgttgtgcaggtttggctgaaattgtactttcactaaacacaactggaatattgtttttacgaactaaatcaatcactttacgcacttgttgtggtgtgccttgttgttcagcattgattggccataaataaccttcttttaagttgtaatctttcgccaaataactgaaagcaccttcacttgttacaagccagcgttgcgcttctggaatttgtgctaattttgcacgaagcggttcatcaagttgtttaattttttgagcatagtcagcggcatttttttcatacacagctgcattttgtggatcgtatttcactaacgcattcttaatattttcaatataaattaaagcattagatggcgacatccaagcgtgtggattaggcgcatctttatacgggccttcataaatagataatggttgaataccttctgttactaccacagcaggtttatctttaacattttggaagaaacgctcaaaccaacgttctaaatttaagccgttccataaaattaaatcagcagattgtgcttttacaatgtcttttggcgttggttcatattcgtgaatttcagcacctggtttggtaatagattccactgttgccgcattgcctgccacattttgcgcaatatcttgaatcacggtgaaggtggtaacaactttgaattttgcattagcttgcattgcaaataaaccaagtgcaagtgcggtcataattttgaatgaatttcgcataagatgtccttatttaaaaaagatagattgaatgcctgaataattgttcaatagctcaacaattattcatcggagataatagtactactttttatattgttttggaatgggaatgattatcaaaataatagatttatttataattatttcgtacaaaatgtattgaatgtatgaaaaaagaacaaaacattttggttagtattaagttcagcaatagtcttggctgcttgtgatgataaacctaaaatgacagaacaaaccaaaacaactgaccaagaaaaagtcactgtagaacagcctgctcatcagctaaaaaatgcgagataaaacaaactgttatctcgcatttttatgtttatgaacattattttgataatttctgaattagcgtattaaatcccacttcatcatagccatcttcatattgggcttctcctgctacatcacgaattgttcttccatttaatgccgtgcagccgaatttttctaatttgcttttagtaaaactagaacgatacgctgaggaagtgttatttaaactaattacgccaatagttgcatttttgcatcggtgtttattaatgaaaacgagattataaccagattcttgaatgtagcctgttttattcactgccgcatcaaaaatttcatcacgcactaacttattggtatttttaatataaagtttttgtttccctgcttggatataagttgcactaagattagataaacgtttaatgtccgatttatttaatgaatatttggcgagcttaactaaatccattgggctggaaatattatagctagataatcctgaactatcgtgaaaacgagtagaatacataccaagttgatgggctttttcgttcattttcttaataaattggcgacgacttattcccgctgcacgagaaagcgcgtgggcggcatagttatcagaatggacaagcattgctttcaataattcgttacaagaaataggaatatttttaggtaattttgttccagtgcctttaattcgatccgtatcctcttttgtgattgcgattcgacaattaggatttttattattctctaaaaatacattagccgtcattaattttgttacagaggcaataggctgaatactatcagacgcgtggctttccaacactcgattatgggtaaaatcatacacaacataagactgtgccaacgcaaaagaaggacacaaagataaaataaataaagcttttttaaacattattggtcaccttaaaaaataggctgatattttaccgcactttttccgctgtaattgaaaatatttgcgatctagatcgcaaaaaagtgcggtaagattttctatcgtttttcaattccgctagattatgcggtgacaaatctgtacaatcgccgttcattttttaattgcgaatttttcgttgtgagtttttgataaaaacacctgcacaatgctatcgccacaatgtgtaataacgaggctaaaatgtcagaattattgtctgtgcaatcagatgcacccgctaaaaaaattaatctaatggatttaacgcgccaacaaatgcgcgaattttttaaagaactcggcgaaaaaccatttcgagcagatcagttagttaaatggatttatcattttggcgaagataatttcgacaatatgacaaacattaataaaaaattacgtgaaaaacttaaggcggttgcagaaattaaagccccagaagttgccgttgagcagcgttcagccgatggcacgataaaatgggcaatgcaagtgggcgagcagcaagttgaaactgtgtatattcccgaagcagatcgcgcgacgctttgtgtatcttcccaagttggctgtgccttagcttgtaccttctgttcaaccgcacaacaaggctttaaccgcaatttaacggtttcagaaattatcggtcaagtatggcgagcctctaaaattattggcaactttggcgtaactggcgttagacccattacaaatgtggtaatgatgggaatgggcgaacccttattgaatgttgctaatgttgttcctgcaatggaaattatgttagatgattttgcctacggtttatcaaaacgtcgtgtaaccttatcgacttctggtgttgtgccagcattagataatttgagcaaaatgatcgatgtggctttggctatttcattacatgccccaaacgatgaattacgtgatgaaattgtgccaatcaacaaaaaatacaatatcaaaacattgattgactcggtaaatcgttatttaaatgtatcaaatgcaaatcatggcaaagtgacgattgaatatgtgatgctcgatcatgtaaatgatggcgtagaacacgctcatcaacttgcagaagtattaaaaaatacgccttgtaaaattaatttaattccgtggaatccgttcccagaagcaccttatgcaaaaagctcgaatacgcgtatcgatcgcttccaaaaaaccttaatggaatatgattttaccgtgattatccgtaaaacccgtggagatgatattgacgcagcctgtgggcaattagcgggagatgttatcgatcgtactaaacgtacggcaatgaaacgccaatttggacaaaatattggggtgacagaagttaattaatattctaggtatgtgaattaatcaagttcacatacccctatgttttcatacaaattaaagcatattaagtatttcttcctgcccaattaaaaggaggaaaaatgaaaacaataagtaaacaactaagtgcggttattttccctttcattttttctgcctgcgtttcacaatctgcatctagcttaaatcatcaaactgccgctaaagcgcgtgtggaactcgctttgagctatcttcagcaaaataatcctcaactggctaaaatcaatttagacaaagcacttcaacacgataaaaattactatctcgtgcattcagcacttgcacattattatcaacaacaagggcaaatagaaaatgcctttcgtgaatatgaaatagccgtaaaccttaatcataaacaaggcgatgtgcataataattttggtacgtttctatgtagtcaaaagaaatttgaacaagctcagcaacaatttgaattagcacttaattcgccgaattattatcatcaagcagatacatttgaaaatatcgtgctttgtgcttattccgcgcaaaaaatggatatttatcagcaaacattagaaaaattacgtcaaatcgatggaaaacgtgcggaaaaattcaatagcctaaaataaagcattgccaaatcaagtattggactttaaaatttagcctccatttaccgcctaattatttgattaaatttatgaatccaactactgagcaagtgctttcccctggtgagatttttcgtcaaacacgcgaagccttaaatctttctcttgaagatgtcgctaaagaaatcacgctacgcccttctatattagagcaacttgaaaataatgaatttattcaaaaatctacccctgcaatctttgtaaaaggttatgtgcgtagctatgcaaagttcttacgtttgccagattctgtgtgggaaaatattgtttttgctgaaacagaaaaaaatgatttagggaaaaatgcacgttcaacccgtgccgttaatcaatattcctctcacaatcgttggatcgggcgtttaaccgcaatagtattcatgattgtaattggtatgactgggctttggtggtggcagagttatcaacaaaatactcaagaacgcgatgatttagtgcaaagctatgttgcctctaccgaaaacaatcagcccgccaccgctcttgtgacaacagaagaaagtaataaaactgtaccagaaacagcagcaccagtctcacaaccagtagaaataacaaataatctgttaccagaaatagcacaagaaaatagcgtttcacaacccaaaaacgatgaaaaatcagtttcagaaattcaaagtgcggtcgaaaatccaagtatttctccaacattacctatagcaaaaggcgatttagtgattgaaatactaacaaatagcagttggattagtgtaaaagataacgctcgccacgtattagcacaaaaagaatataaacaaggcgaaatattaacctttaatggcaatgaattttcattaattgtaggcgcgccaagcaatgtgcgcatcacttacaaaggcgagaattatcctctgaaagtggatggtcgtgtagcaaaattcaaactttcacaaccttagggaaaaataatgtcagcttttcagccaactattaagcgtcgtgaatcgacaaaaatttatgtgggaaatgtaccaattggtggggatgcgcctattgccgtgcaatcaatgacaaatactcgcaccactgatgtggaagcgacagttgctcaaattaaatcattagaacgtgttggtgcagatattgttcgtgtatctgttccaacaatggatgctgcggaagcatttaaacaaattaaacaacaagtgaatgttccgctcgtagcagatattcatttcgactatcgtatcgcgttaaaagtcgcagaatatggagtggattgtttacgtatcaatcctggcaacattggtcgtgaagatcgcgtccgtgccgttgttgattgtgcgcgagacaaaaatattccgattcgtattggtgtaaatgcaggctctttagaaaaagatttgcaagaaaaatatggcgaaccaacgccagaagccttgttagaatccgcattgcgtcatgtagaaattctagatcgtcttaacttcgatcagtttaaagtgagcgtaaaagcctccgatgtattcttagcggttgaatcttatcgtttactggctaaagcaattaaacagcctttacatttaggcattacagaagcaggtggcgcacgcgctggtgcagtaaaatctgcagtgggtttaggaatgttattagctgagggcattggcgatacactacgcgtctctttggcggcagatcctgtagaggaaatcaaagtcggttttgatattttgaaatctttacggattcgttcaagaggaattaactttattgcttgcccaacctgttctcgccaagaatttgatgtaatcggtacagtaaatgcgctagaacaacgccttgaagatattattacaccaatggatgtatctattatcggttgtgtagtgaatggtcctggcgaggcactcgtctccgatctcggcgtaacgggcggtaacaaaaaaagcggttattatcttgacggagaacgccaaaaagagcgttttgataacgaagatatagtgaaccaattagaagcaaaaattcgtgcgaaagtcgcacgacaagatccaaaaaacagaattatttaaggaaagctcgtggcaaaaacaattcaagcaattcgtggtatgaacgattgtgccccaacagaatctccattatggcaatggattgaagcacaagtacgcaatgtattaaatagttatggctattcggaagtgcgtatgccaattgtagaaagtacgccattgtttgcgcgtgcaatcggcgaagtaactgatgttgtctcaaaagaaatgtacacattttgggataacgatgaacaattaaccttacgccctgaaggcacagcaggttgtgtgcgagcagccattgaacacggttggatctataataatgaacaacgcttatggtatatcgggccaatgttccgtcatgaacgtccacaaaaagggcgttaccgtcaattccatcaagtaggtgttgaggtattcggtattgcaaatccagaaatcgatgccgaattaatcatgcttacctatcgtttatggaaagcattaggtatcgatcaacatgttacacttcaacttaactcaattggttctttagaagctcgagcaaattatcgttcagctttagttggattcttagaaaaccatcaagatttaatgagcgatgaagaaaaagagcgtttagtaagaaatccgcttcgtattttggatacaaaaaatccagaattacaaaaagtattagataacgcgcctaaattgcttgattatttagatgatgaaagccgtacgcattttgaacaattatgttcattattagatgcagtgggtattcaatatgaaattaatcctaaactcgttcgtggcttagattattacaacaaaactgtatttgaatgggtaacctctgctcttggcgcacaaggtaccgtgtgtggcggcggtcgttatgacggtttagtggaacaacttggcggacacgcaacgccaagtatcggatttgcgatgggattagagcgtttagtcttgttggtgcaagaagttaatccaaatgttcctgcgaaaagtgcggtggatatttatgttgtttatcaaggcgaaggcgcaacattagccgcttttgaattagcggaaaaagtacgctcggaattaccgcacttaaataccatgttgcactgctctagcggtaattttaaaaaacaatttaaacgtgcagataaatctggtgcaacattggcattagttatcggcgaaagcgaagtacaaaataaacaagtcgttgttaaacacttacaaggtggcacagatcagcaaaccttagatttagtgaatataatcgactatcttcaaactcaattttaatttaaaaggggaaaacatggcttattccattgaagaagaacaagagattaaccagttaaaagactggtggaaagagaatggcaaaacaattattgtcgcttttatcttaggtgtgggtggtatgtttggatggcgttattggcaaactcaccaagcagaacaaatcgctcaagcttctgcacaatacgatactttaattaattctgtgcaacaagacgaacaggctaaaaaagcaaatatagaacaatttgtgcaagcgaatagcaaaactgcatacgctgtatttgctttgttagatgaagcgaaaaaagccactgaaaaacaagatttttcagcagcagaagcaaatttaaaccaagcattaacccaatctcaagatgaagtattaacatctattgttgcattacgtctaagtgcggtgcaattccaattaggccaattagataatgctttaagcacattaaaccaagtgaaaggcgaaagttttaatgctcgcaaagcgattttaacgggcgatatccaagttgcaaaaggagataaagttgcggcgaaaaacagctttgagcaagcacaacaaagtggtagccaattagaacaacaaatggcaaaaatgaaattaaacaatctttaaaaaataatacccgcatcaaagtgcgggtattttttcaatcaaatttctgattattcaaattcatctaaccattttaataaaatagcctcaagaattgattcatttgatttattcggatcatcgtcaaaattctcaagttcacaaatccatttatgtaaatcagtaaaacgaactgtttttggatctaaatctggattacgatcgtaaagttcttctgcaattaattgggcgtctgtccatttcattagtgagccgcctcatttgcgtgattaaggttatattttggaatttctaccacaagatcttcatttcccacgacgcattgacaagataaacggctatccatttctaatccccaagccttatctagcatatcttcttcttgatcactcgtttcatttaaagaatcaaacccctcacgaacaatcacgtggcaagttgtacaagcacaagaaccatcacaagcgtgatgaatttctactcccgcattgtgagcaacttctaataagttatctcctgttgcagcatcaacgaccataccttcaggacaaaaatcttcattaggtaaaaaaatcacttttggcataatactttcctcaaaattatttaatatctgactgcagttttacggattttcaatgtctgacagatttttacctgtcaaagctttattaattgatgcattcattcggcgagcagcaaattcttgggtagcagtgtctaaggctttaattccttgcgcaattgcatcgcgatctgaaccttgttttacatccattaattgttttaacacagtttcaatatgatgaaattcatctgtgctaagcaattcagccccatctgcttgtagcgcaacaatcacgctttcaataacacgatctgcttccacacgctgctctgccaattcacgtgcttgtaaatcttcttgtgcattatcaaaagaagatttaatcattgcggttacttcttcatcagttaatccataagatggtttaatttgtattgaagcctgtacttttgtcgatttttccatcgctgtaacgcttaataaaccatctgcatccacttgataagtcactctaatatgggctgcccccgccgccattggtggaatacctcgtagagtaaagcgtcctaaagaacgacaatcatcgactagctctcgttcaccttgtagcacatgaacagtcattgccgtttgcccatctttaaaagtagtaaactcttgcgcacgagccacaggaattgttgtattacgtggaataattttttccactaatccgcccatcgtctcaatgcctaaggaaagcgggacaacatcaagtaataacatatcagaatcagttttattcccgactaaaatatctgcttgaattgcagcaccaagtgccacaactttatcaggatcgattgaggttaatggtgttttaccaaaaaactctccaacttgttctcttacataaggcacgcgagttgaaccaccaaccattactacggcttgtacttcttcggattctacattggcatctttcaatgcccgacgacaagttagcaatgaacgttttacaagcggataaattaattcattgaattgttcccgcgaaatctctactgaaaaatcttgccaagaaataaccgcacttttttcattagtcaaggtaattttagcttggttggcaagggttattagctcacgctgttgatttgctgtttgtggttttagcttagtttgttctattacccaatctgcaattaaatgatcaaaatcatctccacctaatgcagtatctccccccgttgctaaaacttcaaagataccttttgataagcgtaaaattgaaatatcaaatgtgccaccgcctaaatcataaaccgcaataatgccttcttgcccactatccaatccataagcaagtgcagctgcagtaggttcattcaataaacgtaatacatttagcccagctaaacgcgcagcatctttagtactttgtcgttgagcatcatcaaaataagctggaaccgtaatcacaaccccagaaagctcacctccaaggcgttgttctgcaatgtgatttaagcgcgataaaatatctgaagacacttcaattggacttttagccccctgtgccgtaataattaaaggtaatccattttcactcgccacaaattcataaggcaaactagaataacgagactgaacatcagaaaggctgcgaccaattaagcgttttactgaaatcaccgtatttttgggatcaagtgaggcttgttcaaaggcttctaaaccaactttcttctcttcaacgccataatgaacaactgacggcacaagactgcgttcttgttcatcattaagaatcacggattgcccactacgcacggatgcaaccaaagaattggttgttcccaaatcaatcccaacggctaaacgatgttgatgcggtgccgcagcttgtcctggttctgcaatttgtaataatgccatatgctatttttctactagttatgcgacggaatacgccaaatcaaatttatttttttctgcaaagtttgcttggtaatgggtttcaatattgacttcctgtttttgacgttcatcaattgctatttttctgtcttggtttaaatcaggcgtaaatacaaaaacttggttaccatctaattgttttacatcatcttgccaatttttccaaaatagcccttgataaaaggcctctacatcgccattcaatacccaagctaaaaattctgtgtaagtaaaatttaaattatgccaagtaagatcttttgatgaatagtaataaatttttccaatattattgcctaacgaaccaccatttaacgcaaaataaccaccaatcacatcatctgcaactaataaatattttggtttttcgcctgactcactaaaagatttactgaaattccaatccatcaagccacgcggtaatttaaaacttccagaacctaaaatacgtaaccaaccataatgaattaaaattccacctgtttcatagattactgcacccattggcgaggatgttggcatttgcatagtaaaaagctcacgctccgcactggattgatcttttttaattacttcacaatgattgcgagcgttatcaatccattgggaaagggttatccaagcagaatgttctgggctagtgagctgttcaagagtttgcatagtgttatttattcacatctcgtaggggcaaattacatttgcccccacatttaatctaattcaaaaattcgttcttccacacgttcaatttcttcagaaagtttatgggtaaaacgtaatttatcacagtattgagatgctctcgcccattgttgagatttcaaactctcaaaaagtgcggtcaataatgattgagtttcttgtttaatttctttagcaaaagcatttaatgctctttcatcttgctggcgttcaacttcttctaattgttcgcgccattgtaattgttgcattaaaaacgccacatcttgcgtgcttttttgttcaagatctaactgctcaccagtattaagagcaatgatcgcttcagctcgcaaaattgggtcttttaacgtttttaaggcatcattcacttcggtagatttttgcatcgcaacacgttgatctaaagcattacttgagacaaaattatctggatgtagggccttttgtaattttaaataacgtgcatttagtactttttcatccagctgaaaatcaactggcaaatcaaaaatttgaaaaggattgaacatcagattattaccttaaacgtggaaactttcgccacaaccacaagattcttttacatttggattattatatttaaagccttcatttaggccttcttttacataatccagctcaatgccattgagataaacgagactttttggatcgacaataatattaacaccgtactgctcaaaaacttgatcttcggaatttaaaacatctacaaactcaagtacataagctaagccagaacaacctgatgttttcacacctaaacgtaatccaatacctttaccacgattatccaaaaaggctttcactcgctgcgctgctttttctgttaatgtaatacccatctatcccccaacaccgctaaaaatgcggtcaaaattgaccgcactttttcacatgattagccttgttttgctttataatcagcaattgctgctttaattgcatcttctgctaaaatagagcaatgcactttcactggcggtaattctaattcttcagcaatttggctatttttaattgctccagcttcttctaaagatttaccttttacccactcagtaattaatgaactagatgcaatcgcagaaccacagccgtaagttttgaattttgcatcttcaataatgccattatcatctactttgatttgtagttgcataacatcaccacaagctggcgcaccaaccattccagtaccaacattgctatcttttttatccaatgatcccacattacgtggattttcataatgatcaattactttttcgctataagccattttaactttccttttttcaattctagtgaatgccattgtcagataatggcaactaaatattagtgagctgaccactcaatggtatttaaatcaataccttctttaaacatatcccataatggcgataatgcacgaagtttttctaccgcacccttcattaaattaattgtgtaatcaatttcttcttcagtagtataacgacctaatgtgaaacgaattgaactgtgcgccaattcatcatttaagccaagtgcgcgcaatacataagatggctctaagctagcagatgtacaagcagaaccagaagagacagcaatatcgcgcaacgccatcattaaggattccccctcaacatagttaaaactaatatttaaattgctatctaaacgatgttccattgaaccatttacataagtttcttcaatatcttttaagccattatataaacgatcacgaagtgcttttaaacgcggcatttctgatgccatttcttcttttgcaattcgatatgcctctcccattcctacgatttgatgaacaggtaatgtacctgaacgcataccacgttcgtgaccaccaccatgaataatcgcctctaaacgtacacgaggtttacgacgaacatacaatgcgccaacaccttttggcccgtaaagtttatggctagacatcgacattaaatcaacagctaattcttccaaattaatttcaactttaccaacactttgagttgcatccacatggaaaattgttttatttgcacgacaaagttcgccaatagctttaatatcttgtaacacaccaatttcattattagcgtgcataattgaagctaaaattgtatctggacgaagcgcagctttgaatttttctaaatcaattaaaccatcagcttctggagacaaataagtgacttcaaaaccttctcgttctaattgacggcaagtatctaacactgctttatgttcagttttacaggtaataatgtgtttacctttagtttgatagaaatgcgccgcacctttaatagcgaggttatcggattctgtcgcaccagaagtaaagacaatttcacgagaatctgcgccaatgagatcagcgatttgattacgcgcaatatcaacagcttcttctgcttgccaaccaaatttatgtgagcgagaggctggattaccaaatgtgccatcgatggttagaaacgccatcatttttttcgcaacacgttcatcgactggacaggtcgctgcgtagtctaaataaataggtaatttcattttcactcctaaattatgctaaatataaccgcacttttttattaaaaaatatactgcttatcttttttattgattaactaataaattattaaaatcacgatgagattgacgttttacattacgcttatttaccagctctgctaacgtaatctcatttaaaaaactttcaatacgtaaacttaaatcttcccaaagttcgtgagttaaacattccacaccatttttacaattttcacgccccagacatttcgttacgtgaatattttcatttactgccgcaataatcattcctacagaaatttgttcacttggtagccctaactgataaccacctcctggcccgcgaacacttttgactaaaccgtctttacgtaatttagcaaaaagttgctctaaataagataaggaaatatgttggcgttcagaaatatccgcaaggcttacaggcccgccatctgcatttaaagcaatatctaaaacggctgtaactgcataacgacctttcgatgtaagtttcataaagaatccctaaaaattaattgcgcaatacttacatatctgactaatttagtcaattatcctcttttgttaaatcaattcgtttttcaaccgcacttagcatgccatttaaaatatttaattcgtttttctctaattttgcacgatagtataaacgctttaatttacgcataactccttgattttgaataaatccaagagactgatatatacgttctgtgtagtcaaaaaaataagctaactgatctgttgttggatagtttttctctattaaagaaagtgaatttttcttattattttgaactaagaaagccakacgcaattcataacttaccagctgcacagccattgctaaatttaaagaagaataatcaggattcgctggaatattcaagtgataatgacatttcagcagttcttcattggttaatccaatacgctcacgaccaaacacaatagctatcttgcctttatacgctacaactttctccgcgcattctcgaggctcgatcaatgtattttgtaaatgacgtaagcgagcacttgttccaattaccaaagggcaatcatcgacggcttcatcaaaactatcgacaaccctagcattttttacaatattttctgcgccagctgaaagggcataagattgttcatcaacagatttaggtgaaacaagacaaagctgggtcaatcccatcgttttcattgctctagccgcagaaccaatattaccactgtgcgaagtttcaattaaaacaatacgaatattttccaacataatgatacccgactaaaatttaagggtattctaccacaataaccgctaaaaatagtcaagaatttaagctaattaaagaaatttaaaatattagggatgaataataaaaatggtgggttgtgagagactagaactctcgactgacggattaagagtccgctactctaccaactgagctaacaacccaactggacaactaaatcagagagtggtgggtcgtgaaggattcgaaccttcgaccaacggattaaaagtccgctgctctaccgactgagctaacgaccccactgtattaaatggatttatgataacgcatttgctctagaaccgaaagaataaattcattctttcaagctaattggttaaattacaaacgatgaaaacaaaacagganccaataaaaaatggatcctgtttttcaagtattagaaatactaagaattagtacgctaacactgcacgacggtttttagaatatgcagcttcatcatgacctaatactgcaggtttttcttcaccgtaagatactgtgcctaatttaccagcatcaacacctttaccagctaaataacctttaactgcatctgcacgacgttggcctaatgcgatgttgtattctggtgtaccacgttcatcagtgttaccttctactaatactttagcagctggcgttgcatttaaatatgcagcgtgcgcgtctaagatttgaacgtattcaccagtaatgtcatatttatcaaaaccgaaataaacggtattgtaacgttgttgaagatcagcaacagagtaaccgccaaaagtttgagcagcaccattgcctgcagcatcgttgttagatgaactacaagctgctaatgcagctacagaacctgcaactaataatgatttaacaaatttgttcattagatttctcctaaatgagttttttatttagttaagtatggagaccaagctggaaatttaacttgaccatcacttcctggaaggctcgccttaaagcgaccatctgcggaaaccaattgtagcacctttcctaagccctgtgtagaactataaataatcataattccatttggagagaggcttgggctttcgcctagaaaagatgtactaagtacctctgaaacgcccgttgtgagatcttgtttaactacattattgttaccattaatcatcacaagtgtttttccatctgcactaatttgtgcgctaccgcgaccacccactgctgttgcactaccaccgcttgcatccattcgataaacttgtggcgaaccacttctatcggatgtaaataaaattgaatttccgtctggcgaccacgctggttcagtattattacccgcaccactcgtcaattgagtaggtgtaccgccatttgctcccataacgtaaatattcagaacaccatcacgagaagaagcaaaagctaaacgagaaccatctggcgaaaaggctggtgcgccattatgcccttgaaaagatgccactactttacgtgcgccagaatttaaatcctgtacaacaagttgtgattttttattttcaaacgatacataagccaaacgctggccgtctggagaccaagctggagacataattggttgggcactacgattgacgataaattgattatagccatcataatctgctacacgaacttcataaggttgcgaaccgccatttttttgcacaacataagcgatacgagttctaaaggcaccacggatcgcagttaatttttcaaaaacttcatcgctcacagtatgcgcgccatagcgtaaccatttatttgttactgtatagctattttgcattaatacagtccctggcgtacctgatgcaccaaccgtatcaattaattgataagtaatactataaccattacccgatggaaccacttgcccaattacaattgcgtcaattccaatattcgaccaagcctcaggatttacctctgcagctgaagttgggcgttgaggcatttgagaaaccgcaataggattaaacttaccactgttacgtaaatcatctgcaacaattttactaatatcttctggtgcagaaccaacaaatggcacgacagcaataggacgcgcaccatcaaccccttcatcaatgacaatgcgtacttcatcgccagcgaatgcattgcttccaacagcaagtacaatcgcgaatacgctcactaaacgttttaataatttcattttgttacctttaaaatttaacaataaatttttctaaagaattatcgaatatcaaagtcaataattggtgatttatatttttcataaatttcatctgatggcgcagctggaacttttttcgttctagccaccgcacttaatgcagctgaacaaatatcatcagagcctgaaattttttgataccccaagattgtgccatctcgacctaattgaattttaatacgacaaacctttcctgcaaaatttggatcttttaagaaacgacgttgaatctctttcttaattacacctgcgtattgatccccaaccttaccaccatcgccagagccaagtgcagcaccgctaccttgagttccacctttatttgtgtttccccctttagatgcactaccgccaccaatatctccgccatttaagaaatcatctaggcttgcttgatctgctttacgtttcgcttccgtagcagctttagcttctgcatcagcttttgcttttgcctctgctgccgctttcgcttttgcctccgcttcagcctttgctttagcttcagcaacggcttttgccttagcttcggcttctagtttcgccttagcttccgcctcttgttttgctttttgagcagcaatttctgctgctttcgctttagcctcttcttcagcttgttttgccgcggcagctaaacgtttagcctctgcatctgcttttaattttgcagcttcagccgcttgtttagccttagcctcttcagcttgcttctgtttttccaacgcttcttgacgagcttgctcttgttgtttttttatttcttgctgacgttgctgttcttgctgacgttttaactcttcttgtcgttgaacttcttgttgatgcttaatctcttcttgattaggctcaggtggtttttcttccacaacaggttctgggcgtttttgtttatccgcttgcccttttttttgttgttgaatacgcccccattcctgagcagccgtaccagtatcaacaatcactgcccctattacatctccttcaccttctccaccacccataatttcaacagtgtgataaagtgagcttaaaatcaataagccaaacaagataaagtgcaaaaggatagaaatagcaaaagcattgattcctttcttttgtcgattattttgcacgtgttacctacttagctaaatgggatttgtcattaaacctacagatttaatgcctgcaagatgaagtaaattcaatgccttaatcacttcttcataaggtacttctttagctccgcctactaaaaatagcgtattattatccttatcaaattcctgtctagataattgagtaaccatttcttctgttaaaccttcttgacgttctccgccaatagaaatcgcatattttccaatgcctgccacttcaagaatgacgggtactttatcttcattagaaacctcttggctttgcacagaatcaggcaattcaacttgaacgctttgactaataataggggcggttgccataaaaattaacactaaaactaaaagcacatctaaaaaaggcacaatattaatttcagatttaattgctttacgctgacgacgagccatatattcctctaaaattttaacttatttttaccgcactttttcttcaaagtgcggtcaattttccctatattttagtgaggggctttaccaaaggcttgacggtgtaaaatcgtcgtaaattcatcaataaaattaccgtaatcttgttcaatggcattcactcgtaagcttaaacggttataagccattactgcaggaattgcggcaaataaaccaatcgcagtggcaatcaaggcctcagcgatacctggcgctaccatctgtaacgttgcttgttttgcaccacttaatgccataaaagcgtgcatgataccccaaacagtgccgaataaaccaatataagggctaacagatgccactgtggctaaaaatggaactcggttttccaaactttcaatctcacggttcatcgcaagattcatcgcgcgcattgtgcctttaataatcgcttcaggtgcatctggatttacttgttttaaacgtgaaaattctttaaatcccacgcaaaaaatttgttcgctgcccgttaatccatcgcgacgattagatagcccttcataaagtttatttaaatcttctcctgaccagaaacgatcttcaaacgtacgcgcttcttttaaggcattcgttaaaatacgactacgttgaatgataattgcccaagatatgattgagaaagaaatcaaaatcacaattaccagttgcacaacaatacttgcttttagaaaaagatctaaaaaattcaattctgcagtcattgcatactccgaaaaattattttaagtgatgaaacgccgctttaacttctttgggaaacgccactggtttcatcttgcctagatcaacacaggctaccttaacagtagcctttgataacatcagggtgttgcgcatcagtctctgttcaaaaaggattgtagccccttttacttctgaaacctctgtttccaccataagtaaatcatccaattttgctgccacgcaataatcaatggcgagcgttttgacaacaaatgcgagttgttgttcctctagtaaggtttgttgcgtaaaatttaatgtacgcaaatattctgttcttgctcgttcaaaaaaatgcaaatagcgagcgtgatacactacgccacctgcatcagtatcttcataatacacacgaacaggaaaagaaaagccattatccaacatattctcacccaattggtcgcaataaaccgtgtattctagaaccagtttttgggataagcaagctatctatgaaaaactcaataagattttattcattttaaaacatctaaaatttttaccgcacttttagcctgactagcaaaagataaggtaatgacaaatcatttttaacctttctcattgagtaaaatctattcaaaacataaccgttctttaaaaatagcctctatgtaatcttaagccaccagtatttttattcttgatatttagcgtttctatgcgacaatctttgcggttatttactttaaaaatatgttttactagatggattacgaaaatcaaattgccaatattttctcactaaatggcgaattaagccaaaatatcaaaggttttcgtcctcgagctgaacaacttgaaatggcatatgctgtaggtaaagcaattcaaaataaatcttcccttgttattgaagctggaacgggtacaggaaaaacctttgcatatctcgcacctgctttagtttttggtaaaaaaaccattatttctacaggatctaaaaatcttcaagatcagctttttaatcgagatcttccagctattaaaaaagcccttaatttcacgggaaaaattgcgttgctaaaaggtcgggcaaactatctttgtttagagcgtttagatcaagtgattgctcaaggtgtgcttggagataagtctgttttagctgaattaagtaaagtacgaaaatggaataatagtactaaaacaggcgatttcacagaatgtatcgagcttgcagaagatagcccaattattcctcaactgacgagtacagcggaaagttgtttaggcaccgattgccctaattattcagaatgttatgtagcaagtgcgcgtaaaaaagcattaaatgcggatttggttgtagttaatcatcatttattttttgctgatatggctgtgaaagaaagtggttttggcgaacttattccaaatgcagaagtgattatttttgacgaagctcatcagttacccgatattgccagtcaatattttggtcaatctttaacatcacgccagctttttgatttgtgtaaggatattaatattgtttaccgcacagaacttaaagatatgcagcagcttggcacaacatctgataccttactgaaagtggtacaagattttcgtttattactgggtaatgggagtaatgttcgaggaaattggcgtgagctttacacgcaaagtgcggtgaaaaaagcctttgaattattacaagagaaaatagattttttatctgaagtaattaaattagcacttggtcgttcccaaactttagacagtatttttgagcgtgttgagtccattaaaatccaactcaaacgtttatctgaaacaaatattgtgggttattgttattggtatgaaggaaatggtcgccagtttggtttacatattacgccattgacagtagctgataaatttggtgctcagctcgaagcgaaagaagccgcttggatattcacatctgcgacattagaagtggggggaacttttaatcatttctgccaacgtttaggcattgaaaatgcgacacaaaaaattttatatagtccctttaattatcctgaacaatctttgctttgtgtgcctcgatatttgccgaataccaatcaaatgaatacattaaattcactaggcgaaatattattacccgtgattgaagcaaacaaagggcgttgttttgttctttgcacttcctattcaatgatgcgtggtttagctgaatatttccgtgaaaaaagtcatctttcgattttattacaaggcgaaacctcaaaaggcaaattactcgaacaatttataaaagaaacgcatagcgttttggtggcaacttctagcttttgggaaggtgtagatgtgcgaggcgatgcactttctttagtgattattgataaacttccttttactgcgccagatgagcctttgttgaaagctcgcattgaggattgtcgtttacaaggtggcgatccattcaatgatattcaaattcctgaagcggtaattaccttgaaacaaggcgttggacgtttaattcgtgatgttacagatcgtggcgttgtgattatttgtgataatcgattagtgatgcgcaattatggcgaaacttttttgaaaagtttacctaactcaagtcgtacccgtgatctcaacaaagtgatacaattcttacaaaataagtaaacgagaataagaatgcaaaatttaactttattggcgttggacacctctactgaagcctgttctgtcgctttattgtatcgtggtgagaaaacacatattaatgaacttgcccaacgcacacacactaaacgaattttacctatgatcgatgaaattttggcaaattcgggtttaggtttaaatcaagttgatgctttagcttttgggcgtgggcctggtagttttactggtgttcgtgttggtgctgggattgcacaaggtttagcgtttggtgcggatttgcctgtcattccaatttcaaatttaaccgcaatggctcaggcagcatttgaattacatcaagcagaaaatgttgttgccgcgattgatgcgagaatgaatgaagtctatttttctcaagtagtgagagaaaaagtgcggtcagattttggggaattttttcaatggcgagaaatcattagcgaacaagtttgttctccagaacaagcgattaaccagcttcaaaatgataacgcatttagagtcggaacaggctgggctgcttattctcaatttactgaaaaaaatctaactggctcagatatagcattgcctaatgccttatatatgttagaacttgcgcaggtagaatacttgcaaaaacacacaatttcagctttagaaattgaaccgatttatttgcgcaacgaagttacttggaaaaaattaccagggcgtgaataagtttaaataactggaggatagaaaatgaaaggaaaaatcaccttattttttaccgcactttgtttcggattaacgggctgtattgcaccaccaaaagggttagaaaaagagcgattctcaattaattcctatcgcgagatttcccctcaggatttgacctgtcattgtaaaacagttcgacttggaggaaaaattgtcaatactaccgttttagcaaatcaaacaaaaattgaagtgttaagtttacccgtatcatcaatttcagctaaaccatttgttgaattgcaatccgatggtcgctttatcgtgtatttcaacggttttgttgagcctgaaaatttaaaagaacgttatattactgtaggtggtcaattagctggaacagagaaaggcaaaatagaacaagctgattatacttatcctgttgttcaagcggataaataccgtatttggacactcagtaccacctatgattatccaacagatgattgggatgaagacgatgattggggattttttagatggagacatcgcctttggtatgttcagcctgaaattcactattatttgaattaaatgataaaatcttaaagattttccaacaaattaggataaaaaatggaaaaaatttggtttcaaaattatccaaaaggttctgaaaaatttctagatacctcaaaatatgaatctattttggatatgttcgacaaagcagtgcgcgaacatccagatcgccccgcttacattaatatggggcaagtacttactttccgtaaattagaagagcgcagtcgtgcatttgccgcatatttgcaaaatgaatttaaacttcaacgtggagatcgcgtggcattgatgatgccaaatttattgcaatatcctatcgcactttttggtattttgcgtgctggcttaattgcagtaaatgtcaatcctctttacacaccgagagaattagagctccagttgcaagatagtggtgcggtagcgattgtcgtggtatcaaattttgcttctaccttggaaaaagtcgttttcaataccaatgttaaacacgttattcttacccgaatgggcgatcaactttcttttggtaaacgtactttagtcaattttgtcgtaaaatatgtgaaaaaactggtgccgaaatataaattaccgcacgcagtgacgttccgagaagtattgagtattggtaaatatcgccaatatgttcgtccagaaatatcgcgtgaggatttagcctttttacaatacactggcggtacaactggcgtggcgaaaggtgcaatgctaacgcacggaaatattataaccaatgtcttccaagcaaaatggattgcagagccatttattggcgatcattctcgcactcgttcagctattttagccttgcctctttatcacgtatttgccttaacggtaaactgcttattatttttagagttaggtgtcacggcgatcttaatcaccaatccgagagatattgaaggatttgtgaaagaattgaaaaaatatcgttttgaagcaatcactggtgtgaataccttatttaatgcgttgttaaataatgaaaatttcaaagaagttgatttttctgcgttgaaactttctgtgggtggcggtatggctattcaacaatcagtggcaacacgttggcacgaattgacgggctgtaacatcattgaaggttatggaatgacggaatgttcgccattaatcgccgcttgtccgattaatgttgtgaaacataatggcactattggtgtgccagtgccaaatacagatataaaaatcattaaagatgatggctctgatgcaaaaattggcgaagctggcgaattatgggtgaaaggcgatcaagtaatgcgaggttattggcaacgaccagaagcaaccagtgaagtgttaaaagatggttggatggcaactggcgatattgtcattatggatgaatcatatagcttacgcattgtagatcgtaaaaaagatataattttggtttctggctttaatgtctatccaaatgaaattgaagatgtcgttatgctgaattacaaagtgtctgaggctgtggcaattggtgttcctcacgcagtttctggcgaaacgataaaaatctttgtggtgaaaaaggacgatagtttaactcgtgatgaacttcgcaaccattgtcgtcaatatctcacaggctataaagtgccaaaagaaattgagttccgagacgaactaccaaaaactaatgttggcaagattttacgtcgggttttacgcgatgaagagatcgcaaaacgtccaaaacattaatgtcaaaatgggatagcaatatcccatttttgttcttttcaaataaaaaaatcactatgataaaagaatgtcaaaatccaccgcactttagggtcgttacggataatactgcgctattagaagtttgtaatttagcccaacagaaaagtgcggtcgccttagatacagaatttatgcgtgtttccacttattttcccaagttgggattaatccagctttatgatggagagcacgtctctttaattgatcctttagcgattacggatttttcgccttttgttgcattgttagccaatcctaaggtattaaaaatcttacattcttgtagtgaagatttattggttttcttacaagaatttgatcagcttccacgcccaatgattgatacgcaaattatggcacgatttcttgggcttggcacatcagcaggattggcaaaattagcacaacaatatttaaatgtagaaatcgataaaggcgcaactcgcaccaattggatcaaacgccccctttctgatattcaacttcaatatgccgcaggcgatgtttggtatttgttgccactttatcatattcttgaaaaagagttagcgaaaacaccttgggaacaagcagtaagagatgattgcgaacttgttcttgctaaaacgcataaattacaagagcgagattcagaaaaagcgtatttagatattccaaatgcttggaaattaaatccattagaattgtctcgtttaagagttttggcacagtggcgacaaaacgtggcaatagaacgtgatttagcactttcttatattgtgaaatcagaacatctttggaaagtggcaaagaataatccacgtaatacatctgaaatgttagaaatgggattaactgaaaatgaagtgcgtgtacgtggtaaggaaattctacaattactttctcaagcaagacgtatttcgtctaatgactatccaaaatctattgaacgtatttctgaagatcctcgttataaaaaaacaattcgattattacaagaaaaagtgaatagcttaacaccagaaggtttaacccctgaaatcgttgcaagtaaacgcactttggaagaattgattaaatgggtttggaaatatgattgttctcaagataaacgaccagagttgctgattggctggcgaaaacctattggtgaaaagttagtcgatgcacttaagtagatataaaaaagcgttgagtaaatagctcaacgcttttcgtttctactcgtagagttttttcacttgttcaggtgtcatcactcgttggtatttactaaattcttttgccatatagtaagcaccaaaatttgttaagtgatcttgatccccatacaagtattttccttctgccataacgctatcttttggtaaatactgttgagcatctacccaataaacattaggaatatctttgactaaatcatgaataattttgttactcgcatcaatatcgcccattctacgaattggttctaaatatttttcaaggccatattttcccagtaaatatccacgaataggcgatctgctaatagaactgttatttgcaaagatataaactgattttgatttagccagtaattttacagtttcaacaaagcgagttttgaagttatcaataaaggaagcctgagcgttaaatcggggaacaggttgtcctcccattcttaaatcataaaatccagaaataaaaatagctttatatttaggtgaattaatctcatcaagtaacccttgacactcaggtgttattttattgtttttatccactaaaacaaaacaatccttcccatcagttatgcttaaaatagttgacttccatccttcttgcttaccaagatattttaaaaaataagtaagatgaccagcatgagaatcccctattgttaaaactgtagttgggaagttattctctaaattaacagataaaacatcttgttcaatatgttctttttcttttctaatctgttttctttcataagtgttataaccaataataaaaagagatggaattagataaagatagataaatgcctgtttaaagtttaattttgattttcttataggttgctcaattaaataataacttgtgatagaaaaaataatagttaatataacaacaattaaaactgtaatgccttgaatctgcttgctgccagtaatgtaataagcaaacgcaataaaaatccaatgatataaataangagaataagganattttnccaataaacactattgctttattaggataancattatttaacggatgttattttgtgatgtggtatgaataattaatgctgtaaaaatacaaggaagaattaaagtaatacctggaataaatgcaatattattattcattaaaaataagcaggaaaataataataatgtacttaaaatagccagaatattatttacttgcttactcaattganccttgtttgaaagattatgataaattgccaacaaagatcctacaagtaattcaggaaatcttaggttagagagataataaatattaggctggtgcaatacttctttgtaaaagttagctgaaacaaaagatgtcgcaagtaaaataaaaaacaaaattagcgttataataaataatactttaacttctctaaattttttataagctaaaatgaggattagtggaaaaataagatagtattgtccttctacggctaatgaccaaatatgtaatacagggttttcatttgcacttaaatcaaaataaccttgtgttaatcctagatagaaattagataggaatgcaatagctaattcaatggttttccttaatttattgaaatcattataaataaaantagcagacgcaatgaaagacactaatgccattactgtaataaaagcaggataaattcgtttaattcgtcgagtataaaattgtttaagcgaaaaagaattctgttgaatttctgtgataataatacccgtaatcaaaaatccagaaataacaaagaaaatatccaccccaagaaaaccaccagataaccagttttcattaagatgataaataatgactgaaataacagcaattgcgcgtagtccatcaatttctggacgtatttaatagatgacataatattccttttataaaatatcgaccgcaccttgatttatgcgtcaaaagtgcggtgattttttatgtgtttttatacgttgaatcggaaatgcattacatcgccatcttgtacgatataatctttgccttctaaacgccatttacctgcttcttttgcaccgttttcaccgttgaattggataaagtcttcataagcgataacttctgctcggataaagcctttttcaaagtcagtgtggattacagctgctgcttttggtgcggttgcgccgactgaaactgtccaagctcgtacttcttttacgccagcagtgaaataagtttgaagatttaaaagtgcgtaaccagcacgaattactcggttcaatcctggttcttcaatgcctaaatcttgtaaaaactcgactttttcttcatcatcaagttctgcaatttcagattcaatcgccgcacatactggaacaactaccgccccttcttttgcagcaatttcacgaacgcgatctaaatatgggttattttcaaagccatcttcatttacgtttgcgatatacattgttggttttaacgttaagaagttgtaactcttgattgcttgcaattcttctttatctaacccaacagaacgaatcattcctgcattttccagcacaggaaggattttttccataacggaaagttcaaatttagcttctttatcgccaccttttgcacgtttttgtaaacgttggattgctcgttcacaactgtctaagtctgctaaggctaattcagtgttgatagtgtcaatatcatcaagtgggtcaattttccctgcaacgtgtacaatgtcatcgttttcaaaacaacgcactacgtgaccaattgcatcggtttcacgaatatttgctaagaatttattacccaagccttcgcctttgctagcacctgcaactaagcctgcgatgtccacgaattccatcgtagtaggtaatatgcgttcaggcttaacgatttctgccaatgcgtctaaacgtggatctggcattggcacgacacccgtatttggttcgatagtacagaatggatagtttgcggcttcaatgccagctttagtgagtgcgttaaaaagagtagatttgccgacatttggcaatcccacaataccacatttgaatcccataatttttcccttattttgagtaaaacggttgtaaaactaaccgcacttttaaattttaaaactgtttaaacgattggtcgctttgaccattccatctctgaaaatcatttctacacaatcagtggcttcatctagcactttttcaagtgcatcgcgatctgctggagatggtttatttaagacataacctgccactaaatcacgatggccaggatgcccaatgccaatacgtaaacggtagaaattattgttattgcctaattgagccacaatatcttttaagccgttatgcccaccatgtccaccgccttgtttgagtttcgcagtgcctggtggtaaatctaattcatcatgaatcactaaaatttcttcaggtttaatacggtaaaaacttgccaatgcgccaactgctttaccgcttaaattcataaaagttgttggcactaaaaggcgtacttcttttccattcactaaagtgcgggcagtttttccgaagaatttactttctggatttagtgaaacgttaaaacgacgagccaagcgttcaataagccattcgcctgcattgtggcgtgtatctgtatatttatcgccagggttgcctaaaccaacaataagttttatttctgacatttttatttgatgatgtaaaaaatagtggcgtattgtagcgaaaaagccttaaattctcaatctataaggcggaaacaaagaggtaatttattgcgcgtgatttatcattaaaagtcaccgcacttttccgttataatggctaaaattttttaacaaagaagtaaaaatgaatcagattaacattgaaatcgcttatgcttttcccgaacgttattatttgaaatcttttcaagttgatgaaggaattaccgtgcaaacggcgattacgcaatcagggattttaagccaatttccagagattgatttgagcacaaataaaattgggattttcagtcgtccaataaaattgactgatgtattaaaagagggcgatcgtattgaaatttatcgtccattacttgcagatccgaaagaaattcgccgtaagcgtgcagcagagcaagctgcagccaaagacaaagaaaaaggagcttaaaaatgaccgcactttcatctgttgatttttgtttacctgaacatatcacgccagaaatttttctacgtgattattggcagaaaaagccacttgtgattcggaacggtttgcctgaaatcgttgggcagtttgagccacaagatattattgagctcgcgcaaaatgaagatgtgacagctcgtttagtgaagacattttctgatgatgattggaaagttttttttagtcctttgagcgaaaaggatttccaaaaattgccagaaaaatggtcggtgttagttcaaaatttggagcaatggtcgcctgaattaggacaactttggaacaaatttggctttattcctcaatggcaacgtgacgacattatggtgtcttacgcaccgaaaggaggttctgtcggtaagcattatgatgaatatgatgtatttttagtgcaaggctatggtcatcgtcgttggcaagtgggtaaatggtgtgatgcaagcactgaatttaaacccaatcaatcgatccgaatttttgacgatatgggcgaattagtcattgatgaagtgatgaatcctggggatattttgtatattccagcccgtatggcgcattatggcgtggctgaagatgattgtttaaccttttcttttggcttgcgttatccaaatttaagcaatttgattgatggcataagcaaaggtttttgtcatcaagatcctgatttgaatttaagcgagtttgatttaccgctacgtttaagccagtctgaacaacgtacaggtaaacttgcagatgaaaatattcaagcgatgaaacagcttttattagataaattggctcattcagaagcttttgatacgttatttaaacaagcagtggcgagtgcggtaagttctcgtcgttatgagttattggtttctgatgaaatgtgcgatcctgatgaagtgcggtcaattttagaagaagatggcgcattcctttctcaagacaacaattgtaaattgctttataccgaaaatccgctgcgaatttatgcgaatggcgagtggttagatgaacttaatataattgagagcgaagtattgaaacgtttatctgatggcgaaagtttagattgggcgtttttatctgatttagccaataaaacagaagatcctgaaacctcaatggatttgttgttggattccatttgtaactgggttgatgatgggtgggcgttaattgaataatatgtcagacaatatttattccgtctctcaactgaattctgccgcgcgtcagatgcttgagggtaatttttgccaaatttggctaacgggggaaatttccaattttacccaacctgtgtctggacattggtatttaacgctgaaagatgaaaatgcacaggtgcgttgtgcaatgtttcgtatgaaaaatttgcgtgtagcttttcgtccacaaaatggaatgcaagtgcttgtgcgtgccaatgtgagtttatatgagcctcgcggcgattatcagcttattattgattctatgcacccagcaggcgagggattattgcaacagcaatttgaagcgttaaaaatgaagttggctgcggaaggattgtttgctcaaaatcttaagaaaactctaccgcactttagtaaagcagtggggattataacttcttctacaggtgcggcattgcaagatattttgcatattctggcacgccgtgatccaagtttaaaagtcgtcatttatcccactgcggttcaaggcaaagaggcaactgcagaaattgtgcaaatgattgaacttgctaatgcgcgacaagaagtagatgtattaattgtggggcgtggtggtggttcattagaagatctttggtgttttaatgaagaagaagtggcgcgagcgatttttcgttcaaccttacctattatcagtgcggtgggacacgaaacagatgtgacgattgccgatttcgttgcagatcttcgtgcgccaaccccctctgctgcggctgagttagttagtcgtaatcaagatgaattattgcaacaacttcgccatcaacagcaacgtttagatatggcatttgatcgtttatttacgcgaaaaagccagcgtttgaaacagcttgccttacgattgcaaaatcaacatccacagaatcagctacgtgctcaacaagcgaaaaatgaacagcttacacatcgcttgcaacttgcaatattgcgtcagtttgaaaatacacaacaaaaattcaccgcactttctgttcgtttaaaacaaaatccattgccatatcgcatacaacgttatcaacaaggcttagagcagttaaaagtgcggttaaatttttgcgtaaatcgccaagtgacggaacgtcaaaataaactggcaacattatgcggaaaactggatggcttaagcccattaaaagtcttggcgagaggttattccattgcggaaaatccgcaaggtaaagccattgttagcgtgaaagatgtcaatcaaggggacttcattacaactcaagtggctgatggaaaaattgtgagtaaggttttgtaagatgcttattttgtaaaaatggagtgaaatactgtttcacttacttctaaaaaagaatgctatgactgttgaataaataatcatggcattttgtttttttgtgactcacttcaaactctcaacaaaaagtggaaaccttctattttttttgtagtcttttaagcgtatgattttgcgtgcagttttggagaaaacagatgtcagaaattcaacattttagccaacaagatatagaaatattgggcgaacaaactttgtatgaaggttttttcacgcttaaacgaatccaatttaaacataaactttttgctgggggacaaagtggcgtcgtaacccgagaattactgattaaaggtgccgcctcagcggttatcgcttatgatccaaaagaagattcggtgattttagtcgaacaagttcgtattggcgcggcttatcatcctgaatctcatcgttcgccttggttacttgaactcattgcaggtatggtggaaaaaggcgaaaagccagaagacgttgctttgcgtgagagtgaagaagaagcagggattcaagtcaaaaatttaacacattgtttaagtgtgtgggatagcccaggtggcatagtggagcggattcatttatttgcaggcgaagtggatagcgcacaagcaaaaggcattcacggtttggctgaagaaaatgaagacattaaagtgcacgtagtaaaacgtgaacaggcgtatcaatggatgtgcgaggggaaaattgataatggcattgcagtgattggattgcagtggcttcaattaaattatgctcagttacaacaaagttggaaacgtagctagggggcattaatgaaaaatacgtttgtttatcaggcggaaaagcctgttataaagttattacaaattaccgatccccatttatttaaagatgaaagtgcggaattattgggggtaaatacacaagcaagttttgctcaagtattaaaggaaattcagcaagaaaataacgaatttratgtaattcttgctacaggcgaccttgtgcaggatagtagcgatgaaggttacattcgttttgtagaaatgatgaaacctttcaataaacctgtgttttggattccaggaaatcacgactttcagcctaaaatggcagaatttttaaatcagccacccatgaacgcagcaaaacatcttctattgggcgagcattggcaagccttattgttggatagccaagtttacggtgtaccacatgggcaactaagccagcatcaactcgatttattaaaagaaaccttaggaaaaaatcctgaacgctataccttggttgtattacaccatcatttattaccaactaattccgcgtggcttgatcaacataaccttcgtaattctcacgaattggcagaagtgcttgcgccttttaccaatgtgaaagctattttatatgggcatattcatcaagaagtaaacagtgaatggaatggttatcaagtgatggcaacgccagcgacttgtattcaatttaaacctgattgccagtatttttctcttgataccttacagcctggttggcgtgaaattgagctacattcagacggttcaattcgtacggaagtaaagcgtattcagcaagcggaatttttcccgaatatgcaagaagaagggtattaaattttgtggacgttttaaaaatcactttcatagtaagcatttttaaaacgtccactattctaacccaataaaagtgcggtcgagtttcagattatttttaacgattcgccagttcaaaaatcatcgcttctgcttggcaactaaaagtgaaagaagcatttaattgaacgccgttttcaactgccacgatttcgcttttaatttcgcaaggatcgctttctgtattgcgcgctttctttgttaatcgttcaagcactgcattggcatcagcttcagtgctataaaattgatgtacttctacgctacagtcagagccatcaataatagtgcctacatcaacacagctacaagttaaggattcttctgctttgcattttacggtcattttctttnccttatatgaatatttttgtgcattttatcatttttctttttccccataaatgacaaaaattcaacaaaacaatccattaaatgcaaaaagctcctgctaactagtcgtagctctaataaaaataaggaatagagttgcactcaatagattcgggctttataattgcccagatttttatttataacaaagggttccaaatgaaaaaatttaatcaatctctattagcaacagcaatgttgttggctgcaggtggtgcaaatgcggcggctttccaattggcggaagtttctacttctgggcttggtcgtgcctatgcaggtgaagcggcgattgcagataatgcttctgtcgtggcaactaacccagctttgatgagtttatttaaaacggcacagttttccacgggtggcgtttatgttgattctagaattaatatgaatggtgatgtaacttctcatgctacaataataacatcaagtagtggaattaaagcaatagagggcggctcagcttcagcgcgtaatgttgttcctggtgcttttgtgccaaatctttatttcgttgcaccagtgaatgataaattcgcgctgggtgcaggaatgaatgtcaatttcggtctaaaaagtgaatatgacgatagttatgatgctggtatatttggtggaaaaactgacttgagtgctatcaacttaaatttaagtggtgcttatcgagtaacagaaggcttgagcctaggtttaggggtaaatgcagtttatgctaaagcccaagttgaacggaatgctggtattattgcggatagtgttaaggataaccaagtaaaaactgcactcacagtacagcaagaaccactcaaatttcttgataagtatttgccctctaaagacacatctgttgtgtcattacaagatagagcagcttggggctttggctggaatgcaggtgtaatgtatcaatttaatgaagctaacagaattggtttagcctatcattctaaagtggacattgattttnctgaccgcactgccactagtgtagaagcaaatgttatcaaggcaggtaaaaaaggtgatttaacccttacattgccagattacttagaactttctggtttccatcaattaactgacaaacttgctgtgcattatagttataaatatacccattggagtcgtttaacaaaattaaacgctagcttcgaagatggtaaaaaagcttttgataaagaattacaatacagtaataactctcgtgttgcattaggggcaagttataatcttgatgaaaaattgaccttacgtgcgggtattgcttacgatcaggctgcatctcgtcatcagcgtagtgctgcaattccagataccgatcgcacttggtatagtttaggggcaacctataaattcacgccgaatttatctgttgatcttggctatgcttacttaaaaggcaaaaaagttcactttaaagaagtaaaaacaataggtgacgaacgttcacttacattgaatacaactgcaaattatacttctcaagcacatgcaaatctttacggtttaaacttaaattatagtttctaatccgttaaaaaatttagcataataaagcacacttccacaccaagtgtgcttttctttttataaaacaaggcgaaaaatgaccgcactttattacacttattacccctcgccagtcggacggcttttgattttatctgacggcgagagcattacacatattgattttgaaaaagagcaatatgcgcctaatccaaaatggcacaagcaagatgaattgcctgtttttcaaaaagtgcggttagcttttgaacgatattttaatggcgaagttgagtgtttttcaaacattcccttaaaaccagaaggcaccgcatttcaacaagccatttggcaagccttgcgagaaattgattatggcgagctttcaacttatggagagctggcgttacggattaataatcctaaagctgttcgtgccgtgggaggcgcggtagggagtaatccgattagtattattattccttgtcaccgcattttaggcaaagatcgtactttaactggttttggtggtggcttagaggcaaaacgttttttattgcagttagagaaaattccctatattgataaaggcactgaaaacacgaagcctcgcttttttaagaaatatcacgaatgattccacaaacccttgaacaattactttcccaagcgcaatcaatcgctggcttaacttttggggagttagctgatgaactgcatattcctgtcccgattgatttaaaacgtgataaaggctgggtggggatgttattagagcgcgctttaggcgcaacggcagggagtaaagctgaacaggatttttctcatttaggtgttgaacttaaaacattgccgattaatgcggagggttatcctcttgaaaccacctttgtgagccttgccccgttggtacaaaattcaggggttaaatgggaaaattcccacgttcgtcataaactttcttgtgtactttggatgcccattgaaggcagccgccatattccattacgtgaacgccatatcggcgcgccaattttctggaagccaaccgctgagcaagaacgtcaattaaaacaagattgggaagaattgatggatttaattgtacttggcaaattagatcaaattaccgctcgaattggtgaagttatgcaacttcgcccaaagggtgcaaatagtcgcgctgtgacaaaaggcataggaaaaaatggcgaaattatagataccttgcctttaggtttttatctaagaaaagaattcaccgctcaaattctgaacgcatttttagaaacaaagtcgctttaacttgattttaaaacacgaaaaaaaccgaccgcactttttagctcgttgccataaaaaattaaggggattcgatttcgttcccaaggtggcacgcctaattcttgccagattttttttatatcttctcttgggcgtttcggataatgtttcactttgcccgaatagccaaaacgaatagaaataggcaagttcgttttttccagcgtaacagagtaatcctgccagtagaaaatcagattatgttcattttcttgaactgtgagattgcctaaatcatcgggtaaatttagcgtattttgttctaattttagggtgcatttggttagatcagaaaacggcttagttaaatataaactatcttgataacgtcgaataactttatttacaagctgaaattgaggatttgcctcttcttttgcaaaaatgacatcattaataagctgtgtaagctggcgtttacttggcatttcaagctggttttcggcaagccacatacgcaaaagtgcggtctgttttgcgagagaatattggcggaactggcacagtttaaattggtttttaatttgacaatgttctgtaaaaatttcgctcaataaatcattaattagctgttgttgctcaaaacaatgttgtgctgaacgttgcacggctaaatcaaaatgagcccagcgttcacgtaattctggcaaaatttcattgcgtaagaaattacgatcgtatcgattatcttcattactttcgtctgtaatccagttgagtttttctttttgcgcgtaattttctaactgggtgcgagtaaagcctaacaaagggcgtaaaattggcatgccgaataatacactttgttgttgcattgcgcctaagccttttagcccactgccacgttttagggctaagaaaaaggtttcagtttgatcgtttagatgatgcgctgtgaccagcatttcttgtgtttgaagatattttttgatggcttgatagcgtgcttcacgtgcgccagcctcaataccattagttttatctacttgtactcgctcaataatcaatggaatttgaaattgatcgcataagtcttgacaatgtttagcccaactgtcggcattggggcttaatccgtgatgaatatggattgctcgtattgataaaggcggtaagtgcggttgtttttgacaaagttttgcaaataaagaaagaagtacagtggaatctaaaccaccactcaaggcaataagaaatgcttgagcggtggctttttggagttgtttttcaatgtctgaaagtaaatccattaggcaactttttcagctttataattgctgcttggattaagaatttcaaaacgtgcagcaatcgtttgtaattcgtaagaacccagttcaaaggtggttttcattacgcctgccacttcattattcattgcttcaaaagcttcaacatcagattttccattgagcaaattcgctaagaatgtacctgcgattaaatcgcccacgcccactggttcaaagttgaattgataaagtggacggcttaaatgccaaacaccctctggggttgccataataatttcaaatgtatcaggatcgttgattttacccgcactgcctaaatgtttaacgagaactttcttcacgccttttgcaatcaacgcattcactgcttttaatacatcgtcaaaggtattaattgggaattcggttagctgacgcaattcgtgtaagtttggcgtcataatatccgccactggaatggctttttcaataagtgcttcgcgaacgccattggcaactacgcagatttttttcggatgtggcattacagggtcgcataaataaagcgcattgggattacgcagtttgatttgttctaaggcaaaaagaatttgatcgacttgttccgcagatcctaagtaacctgatagtaaggcatcacattcttgtagtttttcaatattatcaagtccagttacaatttctcggatttgttcttgtggaatgaccatacctgtccattttccgtattgtgtgtgattagaaaattgaacggtatttaatgcccatacatctacgcctaacaactgcattggaaaagtcgcggatttgttacctgcaaaaccatagactacgtgggattggatcgaaagtacgtttttcattatattttctcctttgttgtatatttagatcaaaaaagagcggtaaaaatcaccgctcttttagaatgttagttagcaataaccgtaagacattaaacgttcatagcgtctatttaataattcttctttgcttagttcatcgagttcagctaaatcttcttttaaacgaagttttaagttttcagctatttctagataactacgatgtgcaccacctaaaggttcttgcacaatgctgtcgatgagatttaattcttttaaacggcttgcggttaatcccattacttctgctgctgttgatgccttttccgcacttttccaaagaatagaagcgcagccttcaggcgagatcactgaataagtggaatactgcaacatattaactttatcgcccacgccaatagctaacgcaccgcccgaaccgccttcgccgataacggtacaaataacaggaacggtaagctgtgccatttcgcgtaagttgcgagcgatagcttccgcttgaccacgttcttctgcgccgataccaggataagctcctggtgtgtcaataaatgtgataattggcaatttaaaacgttcagccatttccattaaacgtaacgctttacgatagccttcaggtgctggcataccaaaattgcgttgtactttttcttttacagaacgacctttttgatgaccgataaccatcactggacgaccatctaaacgcgccaagccaccaacaatcgctttatcatcagcaaaagcgcgatcccctgcaagttcttcaaattccgtaaaaatatgttcgatataatctaatgtataggggcggtttggatgacgcgccatacgtgaaacttgccaagcatcgaggttggcaaaggtttttttagtgagttcgttacttttcttttgtaagcgtttgatttcatcagttaaatcaactttatcatctgatgctgctcgtaatgcttcaatttttgcttctaattcagcaatcggcaattcaaaatctaaatattcttggttcattttgttatcctaaaaagaccgtaaaaatcgaccgcactttatcaaggaattaaactgtggcgcaaatggttttcactggttgggcaagcttataatcgctctcttttaaagagcgataagacaaataaaaacgcggaacaaatcacaacagaaggcccagcagcagtatcataaaaggctgataagattagtccacctataatcgataacatactcataataatcgcccagcccaccatagattctggtgttcttgcaaagcgacgagcggttgccgcagggattattaataaggatgtgataattaatgcaccgacaaatttcatactcaaggcaatagtcaatgcggttaatatcattaaaataaaacgcatttttttgatattaataccttcaacttgcgcgagttctggcgatacggtggtggaaagtaaggattgccaaaagtaaattaatgttgaaagcacaattatcacgccaatgccgatataaattaaatccgtataattaatcgcgagtaaatccccaaataaataattcattaaatctacccgtacattccgtaataatcctactgtcacaaccccgagagataaacagctatgggcgataataccgagcaaggtatcaatagaaaattgcgtattgctttctaaccacaccattgcgatagcaagaattaaggtaagcaccacaatcgcaatgtaaggattgacttgtaagaaaatacctaatgctacaccgagcaaggcagaatgagaaagggtgtcgccaaaataagccattttacgccacaccacaaatacgccaagtggcgcggtaataagcgaaagcacaatgcctgttaaaagggcaggaaataaaatttcaaacattatttatccttattttgacaatgcactgctgatgaattacaaccgcacacatctccgtgtaaagtgtgatgatgattgtgatgatgggtataaaagccgacattttgtgcgatctgatttccccataaacgcataaatgttggatcatttgagagaacatcaggcgtacctgcacaacaaatatgttggttaatacacaatacttctttactatccgccatcacaatgtgtaaatcgtgtgataccatcaatacagcacaatttaatttttgttgggtctgatgaatgagctgataaagttctgcctgaccagtaatatctacgccttgagtgggttcatctagcacaagtaaatttggtttatttaaaattgcacgcgccaataatacgcgttgcatttcgccaccagatagtttttgcatattatttttgcgtaaatgtgaaattgaaagttgctcaagtgcggtggaaatttcttgtgttttaatgcctttttttagcgaaagaaatcgctcaaccgtaataggcaaactatgatccaaatggattttttgtggcacatagccaatgcgaacatttttactgtaaatgacctcgccagaagtgggcgtttgtagttttaataaggtttttaataacgtagatttgccaccaccatttggcccaacaatagtgataatagaattgggatagatatttaaattaatatcttgcagagcggttttttgtgcgaaaaccacattgatattttttaattgaatgagcggttgttggttttgctcgttgcgaatggctgtgatattcataaaatcgccgtgttttcaacaatggttggggaaaataacgcatttttatagaattctcaagattttctctcttatgtcgaatatttaagcgtttgaataatgctttttccataggaatgaattttctttataatctgtagtctgaatgctgaaaacttttttattttagggatgccagtgcaacacgtaaaattagctcgagatagacgaaaaaaacgcgcatatataaaagtaggcgtgttttttgttgctattttgcttattttgacaggcattttactgacaataaaaagcaaacctgaagaaaactccatattttccacctttgacagtggggaatatcacgagttaaatacatcgccaaatgaaaattccaccgcacttcaacctgatgaaaacgccacctcttatgatgatgagctacaagcaaaagatgacgaagttgatgaagtaaaactatcttcagatgatctcgatactttacctcaacacgcacaagacgcactcaatggtttattagacgcagccgatcaagccataagaattactgatcaatttagctatacggtaaccgaaggggatacgttaaaagatgttttagttttgtcaggtttagatgattcatcagtacaaccattgattgcgcttgatcccgaattagcccacttaaaagcaggtcagcaattttactggattttagataaaaatgataacttggaatatttaaattggctggtttctgaaaaagaagaacgtatttatgaacgtctcgaagatgggaaatttaaacgccaagttattgaaaagaaaagtatttggcgaaaagaagtattaaaaggcgagattcaaaattctttaaatagtagtttaagagaaaaaggtcttgatacgcgtcaaattagccaacttagtaacgccttacaatggcaagtgagtttgagaaaactaaaaaaaggaactcaatttgccattttagtttctcgtgaatatttaggcgataaacttactggtcaaggtaatgttgaggcgttacgtatttcatctggtggtaagaattattatgctgtgcaagctgcaaatggtcgttattataatcagcaaggagaaaccttaggcaaaggttttgctcgttatccattgcaacgccaagcacgcgtatcctccccttttaatccaaatcgtcgtcatccagtaacaggacgtattcgtccgcataaaggtgtggatttctccgtttctcaaggcacaccagttattgcaccagcagatggcacagttgaaaaagtcgcttatcaggctggcggtgcaggacgttatgttatgttacgtcacgggcgtgaatatcaaactgtttatatgcatttgagcaaatccctagtaaaagcagggcaaacagttaaaaaaggcgaacgtattgcactttctggtaacacggggatttctacggggccgcatttacattatgaatttcatattaacggtcgagcagtgaatcctcttactgttaaattacccggtactagcagtggtatgacttcagctgaacggaaacaattccttgttcgtgttcgtgaagcagaaagaatgttaaaaccttagcgatataaagtgcggtcaaaaatggtcgcatttttaccttatgtaaaataatatttacactttgttgtaaagaaattatcatagccatatcttaattatctccattccctgaatatgacgatttctaaatttaatcctcaaaaacctttcgagtgttttattgtacaaagtgaagcgatgaaaagtgcggtagaaaacgcgaaacgttttgctatgtttgatgcgcctttgttaattcaaggcgaaacggggagtggaaaagatttgttagcgaaagcctgccattatcagagtttgcgtcgcgataaaaaatttatcgcagtaaactgtgcgggtttgcctgatgaagatgcggaaagtgaaatgtttggtcgaaaagtcggagacagtgaaaccattggtttttttgaatacgctaataaagggacagttttactcgatggcattgccgaactttcattaagtttacaggctaaattattgcgttttttaacggatggatctttccgtcgagtaggcgaagaaaaagagcattatgcaaatgtgcgcgtgatttgcacatcacaggttccacttcatttgcttgttgagcaaggtaaagtacgtgctgatttgtttcatcgcttaaatgttctcactattaatgtgcctgcattacgagatcgcatggctgatattgagccactggcacaaggttttttacaggaaatcagtgaagaattaaaaattgcaaaaccaactttcgataaagattttcttctttatttgcagaaatatgattggaaagggaatgttcgagagctttataacactctttatcgcgcttgttcgttagtacaagataatcatttaactatcgaaagtttaaatcttgctctgccacaaagtgcggtgatttctttggatgaatttgaaaataaaaccttagatgaaattattggtttctatgaagcacaagtcctaaaattattttatgcagaatatccaagcacgagaaaattggctcaacgtttaggcgtctcccatactgccattgcgaataaattgaaacaatatggaattggaaagtagttttcacatttgagatgaaaaaaagtgcggttgaaatttcctgagaattttcaaccgcacttaataaatattgattacccattaatggtattgtgattactctgcttgagtttccacgttttcaactgcttctgttggagcagtatgatgattgttattgtgatgggaaactgaacgagcaggcacaacggttgaaattgcgtgtttatataccatttgattcacggtgttttttaataaaatcacgaattgatcgaatgattcaatttgaccttgaagtttgattccgtttacaaggtagattgatacaggaatgcgttcacgacgaagcgcatttaaataaggwtcttgtaaagattgtccttttgccattttgctatcctttgttgtcgttattatgaaatttgttgatagaaacgagttgtctccgtgtgtaagtgtagcaataaacagaaatattgtctatttgctttcccgcaacttttgcaaaattgctttcatttgatgatctagtgacgcattgaaacgtagtgtttcgccatttttagggtgttcaaaccgaattgaaaaagcgtgcaaaaacaaacgattcaatcctaattcattcatttgtttatcaaaatctttatcgccgtatttatcatctaatgcaataggatgcccagcatattgtgtatgcacacggatttgatgggttcgccctgtgactggtgaagccttcacaagcgtagcatttatatagcgttcttcaatgctgaagcgggtttcagatggttttccttgctcgctgacacgcacaatgcgctctccgctagataattcatttttcaaaagagaggcttgaataacttttatatgggattgccattgcccacgtactaacgctaaataatctttttgaacggttttgacgcgaagttgttcgtgcaaattgcgtaatgctgaacgttttttggcaattaataaaatgcctgatgtatcgcgatctaaacgatgaaccagttctaaaaagcgtgcttctgggcgtaatgctcgtaaggcttcaatcacaccaaaatttaaaccactcccgccatgcaccgcgattcctgagggtttatttaaaataatcaagcaatcatcttcaaacaaaatttggttttcaagtgcggcaactttattgagattttttgaaatcggcgcatcatttttttcagccacacgcactggcggaatgcgtacaacatcgcctgtttgcagtttatattctggtttaattctgcctttgtttactcgcacttcgcctttacgcacaatgcgataaattaaacttttgggtacacctttgagttttgctaataaataattatcaattcgttgcccactttcatcttcactaattgtcagcatttttacggatgaattaatgattttttcattttgttttgtcattttttttccttttgaaaatcgctgcaaatcatatcataaaggcactataaacgtaatatgaacgtcactctatgaacgcaaattcgccttgctaattaatcgttttctatggataatagagcctctttttgcgcctaagaatttgcgtaaaaaaggataagttttgttggtgaaaactcaatgcagcaattggcataagacattgataatcaacatttttcttaaaataaatcagccgtttgcaacgcgtgcggaatatcgcgttgttttatcaagcaaatatttatgcttaataacgttatcaatgcacccagcaacatacagtcgtgagattgactggcgcgagaaacacgaggtcgataatgaagcaaagtgcggtttattttgaggttttttaaatatttaataagagaattgacaatgaaaagaatgttaatcaatgcgactcaaaaagaagagttgcgtgttgcgcttgtcgatggacaacgcctttttgacttggacattgaaagtccgggacacgaacaaaaaaaagcgaatatctacaaaggaaaaattactcgcgttgagccaagcttagaagcggcttttgtagattatggtgcagaacgtcacggttttttacctttaaaagaaattgcccgtgaatattttcccgatgattatgttttccaaggtcgtccgaatatacgcgatattttggttgaaggacaggaagttatcgttcaagttaataaagaagaaagaggaaacaaaggtgcagccttaactacttttgtttctcttgctggcagttatttggtacttatgccgaataatccacgggcaggaggaatttctcgccgtattgaaggcgatgaacgtactgaactaaaagaagcattaagttcattagatgtgcctgacggtgtaggcttaatcgtccgtactgctggtgtgggaaaatcgccagaagaattacaatgggatttaaaagtattattacatcattgggaagcgatcaaacaagcttcacaaagccgtccagctccattcttaattcatcaagaaagcgatgtgattgtacgtgctattcgtgattatttgcgtcgtgatattggcgagatccttattgatagcccaaaaatttttgagaaagcgaaagaacatatcaaacttgtgcgtcctgatttcatcaatcgcgtgaaactttatcaaggcgaagtgccacttttcagccactatcaaattgaatctcaaattgaatccgcattccaacgtgaagtacgtttaccttctggcggttcaatcgttattgatgtaactgaagcattaaccgccattgatattaactccgcacgttctactcgtggtggcgatattgaagaaaccgcattaaataccaaccttgaagcggcagatgaaatcgcgcgtcaattacgcttacgtgacttaggtggattagttgtcattgatttcattgatatgacaccaattcgccatcaacgtgaagtagaaaatcgtattcgtgatgcggttcgtccagatcgtgcccgtattcaaattagccgaatttctcgttttggtttgttagaaatgtcacgtcagcgtttaagcccatcattgggcgaatcttcgcaccatatttgccctcgttgtcaaggaacaggcaaagtgcgtgataatgaatctctttctttatctattttgcgtttgctggaagaagaagcattaaaagaaaacaccaagcaagtgcataccattgtgccagtacaaattgcctcttatcttcttaacgaaaaacgcaaagcaatcagtaatattgaaaagcgtcataatgtcgatattattgttgccccaaatgaagcaatggaaacaccgcactttagtgttttccgtttacgtgatggcgaagaagtaaatgaattaagctataacttagcgaaaattcactgcgctcaagatgaaaatactgaagaatcactgctttctcgtaatgtggaaacaacagctgttattgaacaaccagcggttgaaagtgcagtagttgcactttctatttcagaagcagccccaacgccagttgagcgtaaatcaaatgaaccctctttgttagctaaaattattgcgaaaattaaaggtttatttgcgactaaatctgaagaaaacaaaccgaaaaataaccgcacttcgcgcaatcctaatcgtaatcaacgccgttcacaggatcgtcgttcttctcgtcgtccacgttctgaaaataacgaaacagaaagaaccgaagaacaggttcgtaatgtccgtgagcgtaatcaacgccgtccgcgccgtaacttagtggaagaaagtatcgctgaaagtgcggtaaattctacacctgtttttgaggctaaagaagaaagaactgagcctgtaactcaacgccgccaacgccgtgatttacgtaaacgcgtgcgcgttgaagataatgaaacagttgttgaaaataacttcagcacgactgaaaaaatgccagaagtggatgtaattacggttcaaaataatgatgaaaaacccgttcatcagaaccaacgttctgaacgtcaagagcgtcagcgtcgtactccacgtcatttacgtgcagcgaataatcagcgtcgtcgccgtgatcaagagccaaaatcgccaatgccattatttgctgcggtggtttcgcctgaattggcaagtggcaaggcttggattgattattcaacggtaaatctgccaaaagaaaatcatttcttatctgtggatgaattgcttgagcaagagaaaactaaaaaagggtttatcacgccagcaatgggaattgttgttgaagaaaaatcccctgatgtaaaacctgcattagattttattactcaaccagctaatgaatcggtacagaaaaaagtacaagaatctttagaccgtttaagttcatataaacctcaagaagttgttgaatctattgatcctgcaattaatgtagatgaacctgaaacgctcgagaaagtatcaaaatttgtccgcacttatgaatttaatggacgtttaggtacaatttcttcagtaccccatacaaaagcggagatgactttagcgaaagcaaatgatgaaatgccagaggatttcccaattagggcttggcaggattctcgttattatttctatggaaaaggcgcggcaggacatcattgtgcaattagccacgtttattctgaaccaacccgcacaaaatcagaataatcaaaaataaaaatagaattgacgtaaccaacattacgtcaattctttttattttataaatacagtttgattgaaagcataaaaaaccaatcagtcaaattttgctgttattttatgctttaattaaaacatttttacttatattatagaacagagtaagttgggcatgttgctaccagcggttacacaaaagatgaatttacaacaaaacttacatttaagactaacaatatgccaataggcggagatgtgaaggcggatcaggaaacatcaggttctagaagcataaaacgcattggctttggttttattggtggtattggctatgacattacaccgaatattaccttagacttaggttatcgttataacgattggggacgtttagaaaacgtgcgttttaaaactcatgaagcctctttcggagtgcgttaccgcttttaattaaacaaatttagttttctatttaagcggtcaaattcttctcattatttgcaaaatgagggaaaaatttgaccgcttgttttttcttgaaaagaagcgtaaacttctttcgacttttagtcggggtgccgaaaggctgagatgatacccgtgaacctgaaacagttagcactgacgtaggaaactaatatgccacatattcaacctttctctatcacgattttatcctgtttattttcccaattttctacattttattacacctgctaattgctcacagtgaatagcgggcatttttgtttattttatattcaacacaaggaatgcttatgcaatcaatttatctctccaaaatccgtgagcagaatccgctcattcataacattaccaatattgtagcagcgaattttagtgccaatggcttgttggcattaggagcctcgcctttgatgtcggcgaatgttgaagaaatgcaggaagtaccgaaaatcagtcaagcattggtcattaatattggtacgctgattggtaaagatcgggaggcgatgttgcaggcaggaaaaacagcaaatgaggttggaattcctgtagtgttagatcctgttggtgtgggggcgaccagttatcgccgtgagaccattcgtgagcttttagccgaggtaaaattcgcacttattcgtggtaatgcaggtgaactggctgccattgcaggcgagacgtggcaggcaaaaggtgtagatgcagggcaaggcgaagtggatttaaaagccgttgccgagaaagtggctcaacgctatggctgtacggtgttgattagcggggcggtggatattgtcagcgatggcacacaaactgcgaccgttcacaacggcacgtcattgttcccgaaagttacggcttcgggctgtttattgagtgctgtgtgtgcggcatttttagcagtaagtgaagggaattatttttctgcgacattagaagcctgtgtagcatacaccattgcaggcgagtgtgcggcgcaaggcttaaccacacaagtgggacagttccaaatccgtttgttggacgagcttgctgccctttcccctgaaaccattggacaaagagggcgcatcaatgagtaatgtgaaacaagttttaaccatcgcagggtcagacagtggcggtggtgcaggcattcaagcggatcttaaaaccttccaaatgcgcggcgtgtttggtacatcagcaatcacggcagttacggcacaaaacacacttggcgtatttgatattcaccctattccactgaaaacaattcaagcgcaactggaagcggtcaaaaatgatttccagattgcaagttgcaaaattggtatgttgggcaatgcagaaattattgaatgcgtcgcagattttcttgctgataagcctttcggcacgctggtgctagatcctgtgatgatcgccaaaggtggcgcaccgttattgcaacggcaagcggtgagtgcgttaagccaaaaattgctgccgttggcggacgtgattacaccgaacattcccgaagcggaagcattaacggggattgcgattgtggacgacatcagtattcaacaagccgcaaaagcgttgcaaaaacaaggagcgaagaatgtgattattaagggcggacattcgctcaattcgcaaagtgagctgtgccaagattgggttttacttgcagatggtcgtcattttactttgcaaagcccccgtttcaacacgccgcatacacatggtacgggctgtaccttttctgcctgtttaaccgcagagttggcgaaaggcgaaccgttgcaaagtgcggtaaaaacagcgaaagattttattaccgctgcaatttctcacccattgaatattgggcaaggacatggaccaaccaatcattgggcttacagtcgcctttaaggattgaaagatgaaaaatattcaaaaaatcttaccgctttactttgtggcaggcacgcaagattgccgtcatttgggcgagaacttgtcggaaaatttattattcgtgcttaaacaagcgttagaaggcggaattacctgctttcaatttcgggataaaggcaaattttcgttagaacatacgccctcagcacagaaggcactggcgattaattgtcgtgatttgtgccgtgaatatggcgtaccgtttattgtagacgacaacgttgatttggcgttggaaatcgaggcggatggcattcacgttgggcaaagcgatatgcctgtgcaagagattcgcgctaaaacagataaaccgctaattattggttggtcggtgaatcgtttagacgaggcaaaaattggggaaaatttagcagaaattgattattttggaattggtccgattttcccaacgcaatcaaaagaaaatcccaaaccaacactaggaatggcatttattcaaactttgcgaaatgcgggcataactaaaccgcttgtggcaattggtggggtgaaattagctcacgttaaaaccttacgagaatttggggcggatggtgtggcagtgattactgcaattacgcacgccgataatgtgcaagccgcaacaaaagcattacgggaggcaagtgatgaatacgcaaaatagtttaaagcaagtagcaacagcgacgatggtcggcactgcaattgagtatttcgataactacatttacgcaatggcagcggtattggtatttaaccatcaattcttccatgccgtagatccactttcagggcagattgcggcactttccactttagcacttacttttattgctcgccctttgggagcaatattgttcgggcatttcggtgaccgtttcgggcggaaaaatacttttgtgatgagcttgctgttgatgggtatttccactgtggttatcggtttgttgccaacctatgacagcatcggtatttgggcgacaattttgctctgtttatgccgtattgggcaaggtatcggtttaggcggagagtggggcggtgcagcgttagttgcggttgaaaatgctccagaaggtaaacgaggttggtatggtactttccctcaactgggagccccgcttggcttgttgttggcaaatggcgtattcttaggcattactgcgattttcgggcaagaagctatgactgaatgggcgtggcggataccgtttttatcttccgttatcttagtagcaattggcttatatgttcgcctaaaactgactgaagccccgattttcctcgcggcacttaacaagccaaaacctaaacgcttaccaatgttggaagttgtcactactcattttaagccgtttttcttaggaatgttggtttgcattgctggctatgtgctgttctacattatgattgcctttagccaaatttacgccaaatctgctccaacggtttcagaggcaggatacgcaatgggattaggattttccccgcaaatttttaccgctttattgatggcaagtgcggtttctttggcaataacgattgccgcttcgggtaaatatatcgacaaaattggacgaagaacttggttaatttggacaactgttggagttgcgatttttggtttatccttgccgttatttctcgaaaacggtacaactaccagtctgttttggtttttattcatcggtatggggttaattggaatgggctatgggccattagcgagttttttacctgaactcttccctactcacgcccgctattcaggtgcgtcactcacttacaacatcgcaggcttattcggggcaagtgttgcggcaatcattgccttaccactgaatgctcactacggcttaaaaggtgtggggatttatttaaccctaaacgctgtgttgagcttggttggattatggtttatttcagaaacgaaagataaattactatcctaagatttgaggaattaaatacaacctattaagcggttaaattttatataaaattccactaagaatttaaccgcactttcctttacaagccaaatattttctctacaataccccacctaacgatttaccttgagtaagtccctgacctgaaatcagacaaaagagaatattatgacaacccaattcaaaccagaattactttcccctgcaggctctcttaaaaatatgcgctatgcgtttgcttatggtgcagatgcggtttatgcaggccaacctcgttatagcttacgtgtacgcaataatgaatttaatcacgccaatttgaaaatcgggatcgatgaagcccattcccttggcaaaaaattctatgtagtggtaaacatagcgccccataattccaaactcaaaacttttattaaagatttacaacctgtcatcgatatgaaaccagatgctttaattatgtctgatccaggcttaattatgttggtgcgtgaaaatttccctaatattgatattcacctttctgtacaagccaatgcggtaaactgggcaacggtaaaattctggaaacaaatgggattaactcgtgtgattttatcgcgcgaactttcaatagatgaaattgctgaaattcgccaacaagtgccagatattgaactcgaaattttcgtacatggtgcattatgtatggcgtattctggccgttgcttactttctggctatatcaacaaacgcgatccaaatcaaggcacttgcaccaatgcttgccgttgggaatacaaaatggaagaaggcaccacggatgacgtgggcaacatcgtgccgaaaatcgatcctgctcaacaaattgaagtgaaaaatgtagcaccaaccttaggcgagggtgcggtaacggataaagtcttcctttataccgaatcacaaaagcctgacgaacaaatgacagcgtttgaagataaacacggcacctactttatgaattcaaaagatctgcgtgccgtacaacatgtagaaaaattgaccgcacttggtgtgcattctttaaaaatcgaaggtcgtactaaatcattttattattgtgcaagaacggctcaagtttaccgcaaagcaattgatgatgcagccgcaggcaaaccatttgatgaaagtttaatggatacgttagaatcccttgcacaccgtggttataccgagggtttcttacgccgtcatacgcatgatgaataccaaaactacgaatatggctattctatttctgatcgtcagcaatttgtcggtgaatttacgggcaaacgtaacgaacaaggtatggcagaagtagcagtaaaaaacaaattcttacttggcgacaatgtagaaatgatgacaccacaaggcaatattaatttcaaaattgaaaaaatgctaaatcgtaaaaatgaaacggttgatgccgcactaggtgatgggcattttgtattcttaaatgtgccacaagatattaacttaaattacgccttattaatgcgtaatttagttaataccaatacaagaaatccacattctaattaacatgctccccgctctaaaggacggggatttctactagctcccacgctccaaaacgataaatatttattgtattttccttgataatgtacgtctattagacgtaaaatataagatattattaacaacataaggagtagatgaatgaaaacacaagtaacaaaagcaagattggaggctaaagtaaacatagatatatacgaattgctaaaacaagctgctgcaattacagggcgaacattaactgactttgtggtaagtgtagcttacgaggaagctaaaaagaccatttcagaacatcaagttttacgtttagcagtgaatgatcaggcattgctgattgaaagtctaagtaaaccatttgagcctaatccatcaatgaaaaatgcgcttgatgtgtatgaagcatatctatctattacagggaaaaataatgataaatgaaaatttagcatatttaagtgtattacccttagaagatttaaagattgagagaagttcattttcttgttcagttgaacctttagaaaagtattttcataagtacgtttctcaagatgtaaagaaagggcttgcaaaatgttttgtacttataaatgaacacaatctaggattgttggctattacactttatcggcattatcaataccaattacagatataccaaaagaacgaataagtaaaggtgtaccatatcctaatattcctgctgttttaatagggcgattagccattgatacgaatttccagaagcaagggtatggaaagtttctaattgcagacgccattcataagattaggaatctacggtagctgccacaattttagtcgttgaagcaaaaaatgatgatgccagctcgttttatgaacgattagggtttattgaatttaaagaatttggaggaacacacagaaagttattttatccgctaacaaaattaataaaatagatgaaaatcccctcttaagaggggattttcatctgtgttataaatacaccaaatattattgattttattcacatatctatactagcaacgagtgtgcgaaacgaagcctataaattttttttcataagaaatccttaattatttaagattattaaattgaactagaacaaagcaaagctatactatacaagcctaaacattactgttacttggcttgcgtcgtttgccgatatttttcgtatccttatgacgcaattttacttttttctttgcctctgtttttttcttttcttcacgtttttctttaatgcgtgccttttgttttttgctgacagatttcacttcgccatcttttggtggcttagtgcgaggttctaaacctgctaaaatgcgtgcctttaaaatttcctcagtataacgtttgattttacctagcaacttgtaatcatgcgcttcgacaaaagagactgccgtgccttttttgccagctcgcgcggtacgtccaattcgatgcaaataagtatccgcactatagggcaaatcaaaattcatcacgtggcttacatcgtcaatatcaataccacgtgcagccacatctgttgcaaccaataccgtcacaatacctgatttcaatttatcaatggcattgttacgttgagtttgtgccatttcgccttctaaatatgcggaacgaatgcctcgtttacgcaatgtttcggaaagttcacgtgcatcttcacgacgacgaataaacacaattccacgggttacttcttcagtttcaataaaacgcgcgagcaatttgattttgtgttcattgctgtctgcgtgataataccattgattgattttttttctttcacggcgacttggttccgcatctactttcacaggatcattcaataaacgctccgcgaaatcgaccaataactctccttctaaggttgcagaaaacaacaaagtttgttttcgccaacgggtttcagctgcaattttttccgcatcttgcccaaatcccatttgcaacattctatcggcttcatcaaaaatcagcatttcaacggaacggcaatcaaaattttcttccttaatgtattgcaacaaacggcctggcgtagccaccaccaaatcttgattggtattgaatacatcaccgtgattttgatacgccacgccacctgtaattgtcgcaatatttaaatgggtgaactgcgctaattcttccgcttgttcagccacttgcattgccagttcacgggttggtgttaataccaaaatacgtggtgggcctggtttacggcgtggataatccaataaatgttgtagcgcaggtaataaaaaagcagcagttttccctgttcccgttggtgccgagcctaatacatcactctcttccattgcggcaggaatggcttccatttgaatagctgttgggcgggaataaccttttttctcaagtgcctttaaaagctcaggagaaagatcgaattgttcaaattgggataaattcattattgtgcggttctttgttaaaattgtcgaggattatacctgaaagtgcggtcaatttacgaaaaatttatgagcagatttacctttaaacagttccatatcaatcaaaattcttgtgcaatgaaagtcggcactgatggcattttgttaggtgcttgggctgatgtaaagcattgtaaaaatattttagatatgggctgtggcacaggattattggcgttaatgttagcacaacgaactgaagaaaactgtcaaattcaagcggttgagttggatcccattgcagcaaaacaagcacaagaaaacatcaataattcagtgtggaaaaatcgcattcaacttactcaagtggatatacaacattttttacaaaccactgaacaaacctttgatttaattgtggcaaatccaccttattttgaacaaggtattgcttgtaaaaatgaagaacgagaattggctcgttataccaagcaaagccacttaaattggttagaatgggctgcaacacgcttgtcggaaaatgggagaataagttttgttttgccttatgaggcaggcaaaacgctcacaaaatccaccgcacttttttgcataaaacagacgaatgtcatcactaaaataggaaaaacgccccagagaatgttgcttacctttgccaaacaacccgaagttttaatgcaagatcaattggtaatttatgatgcggataatcaatacacggaagcgtttattgaattgactaaagacttttatttgaaattttaaaggggaaattcattttcccctttaatcatacactatctaaaataccacttcgctaacaacacacccgcattcactgcaatgtttaagcctgatttaattgggcttgcgagcgttaaacgcgcttgtgtatcttctggcgtcgctaaactttccgtagaactttcacttagcacaaaaaccactttattttttaaccgcactttatccaatgggtcgccttgtttattgtgcgatacgtgaataatttgatagcctgatttacgcaattgcattaaagctgaatcaatataatccgcttctaacacacgaatatattctgcaccaccttctgctacgcgcattgaggctgccgaatacagattttccacattatcggcgacaatatttttcacgccaaaataagcgcaagtacgcaatacgccaccaatattttgcgcattattcacgttgtccaatagcactaaacaatcctcgttacgaggaatatccaaatatccttgcaacgtgaaagcacgcggtttcttcactaataagcaaatgccaccgtgatgttctgttccactcactcgagctaattcttcactatctacaacgtgataagccttcttgttttcggctaaataactcaatacctcgccaattttgtgtgacatttgcacggttgcccacaatcgaacaatactttcaggacgttctgcaaataaagctaaacaggcattttcaccgtaaaccttcatttcttccgcacggtttttcttaattttttcaggtgcacgaggagaaagtgcacccgttttcttttcttttgttttataaaccgtacccgtactttttattgtcacttgaaccttaggttgttctgcatttttatttgatggcgcacgagataaagaaagttgcgtaattctagtttctttcacttcttgtttatcacgaggaaaacgagatttttcgtttctatttccattaaatttatcattaaagtgcggtcgattttgagttggtttttctctgtacttttcccccactgagcgttcttgaaaggttttgcctgcggattgaaaagagggtttgcgtttgtcgttcatagggtttccctgagtaaaaatggctgttttttagccaaaaaatgctaaaatttgtgagcattataacgaaaaaaagccttttttctattaataagcacgtgaaatattgtaaactaacgcactagtctttaatcacgagatggattatgttaatcaataaaaccaaacgagctgaacaaaatttaaataatttgccattccttgctttgcaagctgagcaaattgaatttttgggtagctcggctgaatttaaaactcaaattattgaattaatcagaaacgcaaaaaaacgtatttatgtcaccgcactttattggcaaaaagatgaagcggggcaggaaatcctcgatgaaatttatcgcgtgaagcaagaaaatccacacttggatgtaaaagttctcatagattggcatcgcgcacaacgcaatttattaggagcggaaaaatctgccactaatgcagactggtattgcgagcaacgccaaacttatcagttacctgatgatccaaatatgttctttggcgtgccaattaacacacgcgaagtttttggtgtattgcatgtcaaaggctttgtatttgatgatacggtgctttatagcggtgcaagcattaataacgtctatcttcatcaatttgaaaaatatcgttacgaccgctatcaaaaaatcactcatgccgaattagctgattcgatggtaaatttcatcaatgattacttgttagatttcagtgcagtttatccacttgatgtgaccaaccgccctcgcaccaaagagatccgtggcaatattcgcgcttatcgtaaagaccttgctcaaaatggtgaatattcattaaaaagtgcggtgaaattaccgaatgttttaagcgtatcgccactgtttggcttaggcgcatcaggcaatgaattaaatcaagtaattgaagatttattcttacaagtacaaaaaaaattagtgatttgtacgccatattttaatttcccacgcacattgcaacataaaatagcaacgttattggaaaacggtaaacgagtagaaattattgttggcgataaagtcgcaaacgatttttacattccaccagaacaaccattcaaaatggcgggggcgttaccttatctttatgaaagtaatcttcgccgtttctgtgaaaaatttgagactcaaattgaaagtggtcagcttgtggtgcgtttatggcgtgatggcgataatacctaccacttaaaaggtgtgtgggtagatgaccgctatattttactcacgggcaataatcttaaccctcgagcgtggcgtttggatgcagaaaatggcttattaatttacgatccacaacaacagcttttagcccaagtggaaaaagagcaaaaccaaattcgccaacatacaaaagtattaaaacattacactgaattagaagaattgaatcaatacccagaaccagtgcaaaaacttttgaaaaaatttgcacgaattaaagcagataaattggtgaaaatgattctgtaattataagaaaagttttatattttttcttaaattcgcttccagtattaatctgataaattttgtggcaatcgttctaaaatggctttccaataggttgaagaacgtaaattatgtttacggatgcaatccactactgcatctgcatttccctcaagacaaatttgttgcatttctaaataaaattgctttgttaattcacggtgttttttttctttaaaaaataacaaccctattcgctgataaacgccttttaaactattgaaaattaaacgataaaagggtttgttggcaacaacagtgaattgacgaaataattggtaatcaaattctgtgtaatcttgtgctgtgttttgtaattgctctaattcagcaaaaagtgcggttgatttttgaggggaattttttactgcttcataaatgtaagattccgacattttactacgtaaagagagcatattatcaataattaagggcgcagactgcatatccaaagcaattaaggtttcaataatattcggccctgcagcatcccaaatattatttactttggtgggtttgccgtgctgaattgttagccaaccatcacgagccaaacgttgtaaaacttcacgtagggtggtgcgagttacaccaatcttatcggctaaatcacgttctgatggcaaattactgcccgcaggaaaaacatcttgccaaatactctttacaatatattcctctgctaaagctgctggactttgggcttttaaaatgtcgttattgttttgcattacaattaaaaatcagataaaaatcaaaaaaaatgcaattttataaaaaaattacttggtttttattatcctttaaagggggatatattacaatgttcgcgtgataaaaataatggagttcactatgacaaacattcaggcttttatgaaaaactttcttggggcaagtccagaatggtacaaacttgccattgtggtttttcttattataaatccaattgttttcttttttattagtccttttattgcgggttggttactggttgcagaatttattttcacattggcaatggcattaaaatgctaccctcttcaaccaggtggtctattagcaattgaagctattattattggaatgacaaatgccaaacacgtcaaagcagaaattatggcaaactttgaagtgatcttgctactgatatttatggtggcaggtattttctttatgaaacaattactgctttatgtatttactaaattacttgtcaaaattcgttctaaaattgcactttctattgccttttgttttagtgctgcttttttatcggcttttctcgatgctttaacggttgttgctgttatcattagtgtcgcaatgggattttatggtgtgtatcacaaagttgcatcaggcaataatttaattgatgcggttgatatttcagacgatagaaaaattattgaacaacagcacgaaatcttagaaaaattccgtgcattcttacgtagtttaatgatgcatgcgggtgtaggaactgcactcggtggtgtaatgaccgttgttggagaaccacaaaacttaattattgcagaacaagcaaaatggaactttatggaatttttcctccgtatggcacccgtgactattcctgtgtttatctgcggattactcacttgtttcttggtcgaaaaattcaaattatttggttatggcgagaaattaccagacgaagtgtggaaaatcttatcagatttagatcgcactaattcagaaaaaatgtctaaacaagataaaattaaattaggtatgcaagcgttaatcgcaatttggttaattgttggattagcattccatcttgccgcagtcggtttaattggtttaagtatcatcatttttgctacgtctttcactggtgtgacggatgaacatactatcggtaaagcctttcaggaatctttaccctttactgcattgctcgttgtattcttttctgttgttgcagtaattattgatcaaaaacttttttcaccaattattcacttcgttctttctgcggaagaaaatacacaacttgctttattctatttgtttaatggcttgctttcttctatttctgataatgtatttgttgcaacggtttatattaatgaagctaaagctgcactgactaatggagtaattgcaccgcatcaatttgaattgctttctgttgccattaatacaggtacaaacttaccatcagttgcaacaccaaatggacaagctgctttcttattcttattgacttcatcaatttcgccattaattcgcctttcttatggcagaatggtttatatggctttaccttacacgattgtactttcaatcattggtttactggctattgaatttattttaccagctgccacaatttggttagcaagtttaggtttaattttgccaatttaaggagaaaaaatgctcgcgctattaaaacaattttctgaaaaacgttttgtgtggtttttattggctttttcaagtttagccttagaatccaccgcactttacttccaatatggaatgggcttacaaccttgtgtgctctgtgtttatgaacgtttagcaatgattggcttatttgtagcgggcactatcgcattacttcaacctcgcgttttcatacttcgattaatcgccttggctttaggtttattcagcagtattaagggcttattaatttcatttcgtcatcttgatttgcaaatgaatccagctccttggaaacaatgtgagtttattccaaattttcccgagactttaccatttcatcaatggtttccatttatatttaacccaactggctcttgtaatgaaagccaatggtcattatttggtttaacgatggtgcaatggctagtggttattttttcactatatgtggttattctcacattattgttaatcgcacaagtgattaaaacacggaaacaaagaagattatttaactaaaaaatacggtgaaatttcaccgtattttttattacattaaaatcaaccgcactttattcaacggtaactgattttgctaagttacgaggttgatctacatcagtacctttaattaaagccacataataagaaagtaattgcattggaatggtataaaaaatcggtgcaacaatatcattgacttttggcatcgtgatgattttcattccttcacttggcgtaaatcctgcttctttatcggcaaatacgtataattgaccgccacgagctcgcacttcctcaatgttcgattttactttttctaataattcattatttggtgcaacgacaatcactggcatatcagcatcaattaacgctaatggcccgtgtttcaattctcccgccgcataggcctcagcgtgaatataagaaatctctttcaatttcaaagaggcctctacggcaattggataaaacgcaccacgacctaagaaaagtgcatgatgtttttcagcaaaatcctctgctaaagcttcaatttctgtatcaaaagctaacgctttttcaatttcagcaggtaaagattgcattgctttaataatttcacgttctttttctacagaaatatgacctttaactttaccaagtgccgtcaccaacattaataacgcagcgagctgtgtcgtaaatgcttttgttgatgctaccccaacttcaacaccggcacgcgtcataaatgcaagatctgattcgcgtacgagcgaagagccagcaacattacaaattgttaatgccgccatatagcccttttctttcgctaaacgaagtgcagctaaagtatcggctgtttcgccagattgagaaagggtaatcaataagctatttggacgggtaacaaatttgcgataacgaaattctgatgcaatttcaacatcacagctcactccagctaaagattcaaaccaataacgcgccaccatacctgcattataagatgtaccacaagcaacaatttgaatatgctcaactttttctaaaatgccttttgcaccattaccgattgaatcaacaatcacattttcgtgattgatacgcccttccattgtattaataagtgcggttggctgttcgtaaatttctttctgcataaaatgacggaatttgcctttctctgccgcgtcattttcaagattagactcgtgaatttcacgtttagccttattaccgtgagtatcataaatatcaactgtacgacgtgtaatttctgcaatatctccttcttctaaaaagataaaacggcgggtaacacttaaaagcgcaagttgatctgaagctaagaaattttcaccgatacctaagccaatcacaagtggactaccagaacgagctgccactaaatgttcaggatgacggctgtccattaccaccataccgtatgcaccagtgagttgttttactgcttttttcacagcgtctaaaagtgaatccgtcgtacgcatttcccattcaactaaatgcgcgatcacttcagtatcggtttgtgataaaaagacataaccacgagattttaataattcgcgaagttcttcgtgattttcaataataccgttatgtactacagcaaaagtacctgatgaatgcggatgcgcattagtttctgatggttcgccgtgagttgcccagcgggtatgtgcaattcccgttccaccaattaatggtttttctgatacggcttcatctaaagctttaactttgcctaaacaacgaatacgttgtaattcattttgtttattgattactgcaacaccagctgaatcataaccacgatattctaaacgatgtaaaccattaattaagatttccgctacatctcgttgtgctactgcgccgacaataccacacataagtttnccttatttattctattactaagtttgtttttacatttgccacgcgtttacacaataaaaaacccctgcgcaatcgacagggcttcatttcattgatgttatcaattatttgattgcatcttttaatgctttaccagatacaaatgctggcactttagatgctgcgatttggatttcagcaccagtttgtgggttacgaccagtacgagcagcacgttcatttactttaaatgtaccgaaaccgattaattgtacaggctcaccttcttttaggcttgcagtaattgcatctaaagtcgcttctaacgctgctttagcttgttttttgtttaactctgcagcgtttgcaattgcatcaattaaatctgttttgttcataaatttgtaccttctgttaaataaaaagtttgattctttaaaagtatctttgcgaatttgtcgcaaaaactgtgcaaaggataatctaacttgagatgaattaaaagcaggatttctaaaaattgtgacaaatctcacgttattgatgaaattctataccaawgttagatataccctcagtccgaatttcattttttaaagctaaaattaattcaatatcacgtttttcacattctttaagcaaacgataaacttgccattgcacatcaagttctgtttgaatatcttcattttcttttagcttactttctgaccaatctcgtccagtttctgtttccaataatacccttattgttcccaacgaaattaagcttatttccaccgctttttctaaggtttcgcccgcaataatggcgtgtaaaatttcagctaaagcctgacaggcatctaacgctggcacaacaccaaaactatcataatcattcacatccggaataatcgtttccaatttctccaactgattttcaaagttgatcttgacatctttaaccgttaaatattcccacaccaaattgagaatattttgatacgttttggtttccgcactaagctcgttcatttgacagaacaatttaaaatttggtgccatacgttcacataaagcagccataaaagtaagatgttgccaactttctaagttttctaagcgtttatgaatcggatttcgcatcttatttccttaattcgtaagagttggaatatttattaatcgcatttatgttccgctttacaaagttcaagcgtcacatgaattaatttgcgagcgatagtacccgttggcggtaattctggcaagggttgatcataagaaaaccattgtgcatcgtgaatttcactttcctgcaatgttatttctccgctttcataatcagcaagaaagccgaccatttgagagtttggaaatgcccaaggctggctaccgaaataacgaagattttttattgaaatccctgtttcttcaaaaacctctctctgcactgcttgttcaaatgtttcccctacttcgacaaaacctgcaagcgtcgtgtatattcctccgttagactataatgtcgcttatgatttgccaatagaatttcgtgaccacgacgaaccgcaacaataattgatgggcaaatcacaggataagtttgatacccacagtgaatacattgcacagcaagttcatcttgagtttgttgtgttttatgaccgcactttccacagaatttatgggttttcagaaaatgattaatttccacacctcggcttaatatatggaattcatcctctggcagtgaaagcaagttactcaaactcacatattctcgttcatcactttcttgctcagccacaagccacaacggataatttttccattccccaatttgcattgcctgcaatccttccaaatcaatatctttagcgataccaaaaggcaattcattattcactaaatacagattagaaccttgtgtaagcaaccaataaccaaaatcatcttgttgaagtattttcattttttctccataaaaataaccgcactttcaaaagtgcggtcattataaatcttcttttataactcactaataataagaatgttcgccacgttgatgctcagttatatcttttgcaccttttaattcattcgggaataagctaacaagttgtttttctaccccatcttttaacgtaacatccaccattgaacaaccgttacagccaccaccaaattgtaaaactgcgtaaccatcttcagtaatttcaattaaggttatacgtccaccgtgatttgcaagctgtgggttaatttgagtttgaattacatattcaacacgttcaatcaatggcgcatcatcagccaccttacgcattttggcattcggtgcttttaaggtcagttgcgcaccaagctcttcggtaacataatcaatttctgcttcttctaagaaaggcaaactcacttcatcaataaatgcagaaaaagtattatatttcatttcaatatcgctttcttccacggcattcggggggcaataagatacgccacattccgcattaggcgtaccaggattaaccacgaaaatacgaatatgcgttccttcttcttgggtgtctaaaagttttcgaaaatgcgcttgtgcggcatcagaaatagcgatttgctgggttgcttgttccataattatgtcctaaatacttgagagaaagtatcgggaataatacgcttatcgcgcttttttttccagtgctttatattaagctcgtgccagcccccacacttgaatctcctccacacctaattttcgcaacaattttgagatttcattgagtgtagaaccagtagtaatcacatcatccaccaacgcaacacgacgataaggaaattcatttttcgaaacagcaagagaaaaggcattttttaaattctgacgacgatcttttgcactcaaaccacgttgagtataggtgtgtttcacacgctttacgatattgttcaaattaggaatatccagccaacgacttaattgctgagataataaatctgcctgattataaccccgtcgccactgacgaaaatgatataaaggcactggaatgattgcctctggcaatttaagttgatgcgttcgtttagcatcacgtaccgcaagatataaaagccgagctaaagtgcggtcaatccaaaattgattttgaaatttaaaacgctgaatcaatatcgaaagaggttcaatataatgcccaataatgaccatcttatcccaacttggttcttgtttaagacaattcccacaatgctgcgcataatattgcaattccgaaccacaatgaccgcaataaggaaaagatttaatttgtttttggcaacctgaacataacccattttttgcgatatgaagattgccacgacagtggatacagcgaaaattaaaaaaattcatcatttaaaaagttattttttaccctcacttttttgtttcaacgcctctaacgtttctcctgcttttaaaatatgtggcgtgacgaaaatcactagctcacgtttttgatgtcgttcactttctttgctaaataatcgtttaataacgggtatatcgccaagcaatggcactttatcttcgcttttcgtgattgtatcgtgaaatacgccgccaagcacaatggtttccccatctttggcaaaaacctgagtattaatttcttgtttatcaatagaaaccacctcattttgtccataagcgacacgagaaccaggggaattttgacttaccaataaatcaagtaagatattgttatctttagaaatatgtggcgtcacttccaaaccaagcaccgcctcacgaaattccacagattgcgtatcgttacgagtattactcacgatgtaaggaatttctgtcccctgtttaatgctcgcacttttcttattggtagtgagtaagcgagggcttgcaataatttctacattattttcacgctccaacgcactcaattctaaatcaagcaatcgcccattaattttggcgacttgtaatgctatagagccagcaggtgtcgtcgttgtcgcaaaatttacattaagattatccgcaatattttcaaagctattgcctgtaaggctgcccgcaactcgtcttgcattttcagttggattaaaaatcccccaccgaacgccaagttctttcaaactctcatccgtaattgtcacaattcgcgcttcaatagcgatctgttcaataggcttatccatttcagcaatcagttttttgatattttgcacagaacgaggttcatcctgaataaccagcaaattactgcgatcatcaaaggtaatgctcccagcgggagaaagcaaagagccacttcctgttgttaaggatttcattaattcagaagctttagcaaaatggagttttaccgtgtgactcactaagtgcggttcatttgtcgtaagatttcctgcaacctgacctttgccagattgactgccgtttaaataataaatcccatcatctttattcaaagtaagatgcttactttttgcgattatttgtagcaaacgtggcatatcaatattgtttaatttcaaagagatcttgttttccaatatatctccaatcactaaattcacatcttgttgaaaagctaattgctccagtgtttgagctaaaggtgcttgcgataaacgaataaaaaaacgttcgttatctgttttaggattagcaaaaacgattaatggcaaacaaaaacatactaaaaaataaccgcactttaaaaaatatttcttcataatcttcctttaaaaacttaattttttccattcactactatcacattgctctcctagcttacgcataaattgaacattgttttggttgattttttctacaatatagccctcttgagccacatcaacgccctctaaaacgctgtaaacttgcaaaccttgatcttgcaacaaggcaaaggctttatctttagaaatcactacccccaccaattttaaagcgttcaaaggaatttcagccgcttggcgattttcatccgctccgcatagattattaggcacatctgaggaaattatttctgtttgctccattactgtttgtgcgttatcaaactgagaacggttacgctgtgttttatcgaaaggatcttgtccccaactgcaattcataaaaaataatataatcaggaaaaaccaatgtttcattttgtttccttatctagctgaaaaatgatctcggtttgcaatgggccgtcttcgggtttcataaattgcaaccgacttacagaaagctgtgacgaattagccaaaagtgcggataaaaatgtcttcgttttttcaaaatgacctgtaagctgtaaatgcaaaataggcttttgccccatttcccaacgtaaatgctgagataaaccgttacgcgcagctaaacgttgaatttgtttattcaaaggaataatttgtgcagccagttctggagaaagttttcgactttccgactgctgttgtaaagaggttaaaattttctgttgatgcaacaattctgaacgtttcaccgctaactcattttcaatttcatggaaacgtgaactcccctctatataatctaaaacggggcgaaaaatcaccgcacttaatagcaataaaaaggttaaaccgtgcacataaaaaggctgacttagccattttccaaaaggagtaaaaggatcgttaaaaaaagctttcatttttccgccccttgttccacatcaaagtgaaaaaacaatgtatcttgttcaggttgaacctgacttaatttcacattgggaaaatgtttctttaaaaattgatgaatcagttcaaattctgtttgatcttgcgcgttaccttccaagcttaagttattggcatcttgtttaaatttattcagttctccttgttgaaaaggtaattcacttagctgttgtaaactcttttttacttgctcgttgggaatagatgtcaaaacttcaccaactttcaccgcaatgcgtaactgatcaatttgcatggtagttttatgaagctgttgattaagttgttcaaacgacttttgctgtgcctgcaaattttgtttctgttgttcaatcaaattgctaaaagccaacattaaattaatagcaagcaagataaataaagcgatataaaaagctaaacgacgtaaacgcttttgatgttgataagtacgccaaggcaataaattcatcgacatttaaccacccactttttgttgatgtaaatctttttgccatagcgcgttgcccagcgcaataaaagggagttctgtttctactcgctgccagttttcgggtaatggtgtatgacttgagggaatttgataaacaaaaacttgttcaagttgtccttcaaaacgttcggtaaattgttcataaagtgcggtcaaattttcgtgagattgtaaaatttgtgattgctgagatctttcacaaatcgccaagcaatagtcatcttcttgaaataaaaataaggtattttctgaccgcacttgttcattcaacagatattgaaatgcacgcaaaacagcatttgacgcaacatccaatatattaatattaaatggctgaaaatcttgcaaataagtttgagcgctacttttacgaattgcagtaacctctaatcgaaaaccttgctttaacggggtagaacgataatcaaaccacaattcttctaaaaaaataggcagctctttttcaatcacaaatttacattgttgatgacattcttgcgcatttaacacttgtggcaacattaatactttcgaccaagttaagtgggcgggaatgcttgctacaaactgcaaaggaaaggttttcccttgatattgtgtttttagctgttgtaaaaaacgatttttaaaataacgatcattaacaaagatttgataactttgtggctgttcgagatcatcaaaccacacaaaatcaaaataactctgcttacgatgaatgccgatttgtaaagtgcggtaatttttcagggagaattgcatattctttcctattctttaaaggctgaatcttttatacttaacagccaaatcataggtctcttgacaagaatattcattaacgaagcgagaattttacgatgcggatcgcaaaattaatattaaacaccctattaactttatgtattttaggtttagtagcaggcggaatgttgtatttccacttaaaatctgaattgccctcagtagaaacattaaaaaccgttgaattacagcaaccaatgcagatttatacggctgacggtaaattaattggcgaagtgggtgagcaacgccgtattccagtgaaattagccgatgtgccacaacgcttaattgacgcatttttagcgacggaagacagtcgtttttacgatcatcacggattagaccctatcggcattgcccgtgcattgtttgtcgcagtgagtaatggcggtgcatcacaaggcgcaagtacgattactcaacaattagcgcgtaactttttcttaacctcagaaaaaaccattattcgtaaagctcgtgaagccgtgcttgcggtagaaatcgaaaatactctcaacaaacaagaaatattagagctttatttaaacaaaatctttttaggctatcgttcttatggtgttgcagcggcagcacaaacctatttcggtaaatcattgaatgaattgaccttatcggaaatggcgattattgctggtttacctaaagcaccttcaacaatgaacccgctttattctttaaaacgttcagaagaacgccgcaatgtggtgctaagccgtatgttagatgaaaaatacatcagcaaagaagaatatgatgctgcattgaaagagccgattgtggcgagctatcacggcgcaaaatttgaatttcgagccgattatgtcactgaaatggtgcgtcaagaaatggtgcgtcgttttggcgaagaaaatgcttacaccagtggttataaagtatttaccactgtactttcaaaagaccaagctgaagcccaaaaagctgtgcgtaataacttgattgattacgatatgcgtcacggttatcgcggtggcgcgccattatggcaaaaaaatgaagccgcttgggacaatgatcgcattgtcggttttctacgcaaactacctgattcagagccatttattcctgcggcagtgattggaattgtaaaaggcggtgctgatatattgctcgcttctggggaaaaaatgaccttatcaaccaatgcaatgcgttggacaggcagaagcaatcctgtgaaagtcggcgagcaaatttggattcatcagcgtgctaatggggaatggcaattaggacaaattcccgcagcaaattcagcattagtttctcttaattcagataatggtgcgattgaagcagtggtcggtggctttagctatgaacaaagtaaattcaatcgagccacacagtctttagttcaagtgggttcttctatcaaaccatttatttacgcggcagcattagaaaaaggcttaacactttcaagcgtattacaagacagcccgatttctattcaaaaaccgggacaaaaaatgtggcaaccgaaaaactcgcctgatcgttatgatggcccgatgcgtttacgcgtaggattaggtcaatccaaaaatataattgctattcgtgctatccaaacggcaggtattgatttcacagcagaatttttacaacgttttggttttaaacgtgatcaatattttgccagtgaagccttagcacttggcgcagcctctttcacaccattagaaatggcgcgagcttatgcggtgtttgataatggtggcttcctcattgaaccttatatcattgaaaaaattcaagataacacgggtaaagacttatttattgcaaaccctaaaattgcttgcattgaatgtaatgatatacctgtaatttatggcgaaaccaaagacaaaatcaacggctttgccaatattcctttaggcgagaatgccttaaaaccaacagatgacagcaccaatggcgaagaattagatcaacaacctgaaactgtgcctgaactgccagaattacaatcaaatatgaccgcacttaaagaagatgcgattgatttaatggctgctgcaaaaaatgcttcgtcgaaaatagaatatgcgccacgtgtcattagtggcgaacttgcttttctcattcgtagtgccttaaatacggcaatttatggcgaacaaggtttagactggaaaggcaccagctggcgtattgcacaaagcattaaacgtagcgatataggcggtaaaacaggtactaccaacagttcaaaagtggcttggtatgcgggatttggtgcaaacttagtaaccacaacttatgtcgggtttgatgataacaaacgagtacttgggcgtggagaagcaggagcaaaaacagcaatgcctgcttggatcacttatatgaaaacggctttgagtgataagccagaacgtaaattgtcgctaccgccaaaaattgtggaaaaaaacattgatactttgacaggtttgctttctccaaacggtgggcgcaaagaatattttattgcgggaacagaaccgacacgtacctatctttcggaaatgcaagagcgtggttattatgttcctactgagttacagcaacgcttaaataatgaaggcaatacgccagcgacgcaaccacaagaactcttctaaaaatgaccgcactttagtgtgtaatcgggcgagtcaattggctcgccttcgttattaaacaaataaggaatatataaggaatatattatgctgagttatcatcactcatttcacgctggcaatcatgccgatgtcttgaaacatattgttttaatgctcattttggaaaatcttaaactcaaagaaaaaggctttttttatttggatacgcactctggtgtggggcgttatcgtttatcctcaaatgaatcagaaaaaacgggggaatataaagaaggtattggacgcctgtgggatcaaacagatttacccgaagatattgctcgttatgtaaaaatgatcaaaaaactcaattatggtggcaaagaactacgttattacgcgggttctccattaattgccgcggaattgttgcgctcacaagatcgcgcactattgaccgagcttcatcctagcgattatccaattcttcgcaataattttagcgacgacaaaaatgtcaccgtaaaatgtgacaatggctttcaacaagtcaaagcaacgcttccgccaaaagaacgccgaggcttagtactcatcgatccgccttatgaattaaaagatgattatgatctcgttgttaaagccattgaagagggctataaacgttttgccactggcacttatgcgatttggtatcctgttgtattacgccaacaaactaaacgtatttttaagggtttagaagcaacgggaattagaaaaattctaaaaattgaactcgccgttcgcccagatagcgatcaacgaggaatgactgcgagcggtatggtggtaattaatccaccttggacattagaaacccaaatgaaagaaattttgccttatctcacaaaaacattagttccagaaggtactggaagctggacagtcgaatggattacaccagagtaattctccattataaacgccactaaatttcaccgcactttatagcttaaaagtgcggtaagattttctaagattttaaataaatcccacagttcccaaaagcccattttttcgctagaatgcacgcaatttttgacttaataaaggataacattatgtttggaaaaggcggtttaggcggcttaatgaaacaagcccaacaaatgcaagaaaaaatgcaaaaaatgcaggaagaaatcgcgcaactagaagtaacgggtgaatctggtgcaggtttagtgaaaatcacaattaatggtgcacataactgccgtcgcattgacattgatccgtctttaatggaagacgataaagaaatgttagaagatttaatcgccgccgcttttaacgatgcggtacgtcgtgcagaagaattacaaaaagaaaaaatggcatcagttaccgctggaatgccattaccaccaggaatgaagtttccgttttaattattaggcgcgtgaatataagattcacgcgtcatctctcagtttcctctcattaatcactatgcaaagcagtccacttttagaacaccttattgaaaacttacgttgtcttccaggcgtagggcctaaatctgcgcaacgtatggcttatcatcttttacagcgtaatcgtagcggtggaatgaatttagctcgagcactcacagaagccatgtctaaaattggtcattgttcacagtgtcgagactttacggaagaagacacttgcaacatttgcaataatccacgccgtcaaaattcaggtttgctttgtgtcgttgaaatgccagcagatattcaagcgattgagcaaacggggcaattttcaggacgttattttgttttaatgggacatttgtctccacttgatggtattggacctcgtgaaattggcttagatttactgcaaaaacgcttagtagaagaatctttccacgaagtgattcttgcaacaaatccaacggtggaaggcgatgcgacggcaaactacattgctgaaatgtgccgccaacataatatcaaagtgagtcgtatcgctcacggtatccctgtcggtggtgaactggaaactgtggacggcacaacgcttactcactcttttcttggtcgtcgtcaaatcgactaatcttctcataccattatgcgtttatttatcgccgaaaaaccaagcttagctcgcgctattgctgatgtgctcccgaaaccccatcaacgtggggatggttttattaaatgcggcgataatgatgtggtaacttggtgtgtagggcatttgctcgagcaagcagaacccgatgcctatgatcctaaattcaaacaatggcgtttagaacatctccctatcattcctgaaaaatggcaacttttaccgcgaaaagaagtaaaaaaacaactttctgtggtagaaaaactgatccatcaagcggatacacttgttaatgcaggagaccctgatagagaaggacaattacttgtagatgaagtgttcagttatgccaatttatctgccgaaaaacgcgataaaattttacgctgtttgattagcgacctaaatccaagtgcggtagaaaaagcggttaaaaaattacaacccaaccgtaattttattcctcttgccacatccgctctcgcacgagctcgcgccgattggctttatggcattaatatgaccagagcttataccattcgaggtagacaaactggctatgatggcgtgctttctgttggacgagtgcaaacccctgtgctaggtttaattgtacgtcgagatttagaaattgagcatttccagcccaaagacttctttgaagtacaggcttgggttaatccagagagcaaagaagaaaaaactccagaaaaatcaaccgcacttttcagtgccttatggcaacctagcaaagcttgcgaggattaccaagatgatgacggcagggtgctctctaaaggattagcagaaaaagttgtaaaacgtattacaaatcaacctgcagaagtcaccgaatacaaagacgttcgtgaaaaagaaacggcgcccttgccttattcactttctgcgttacaaattgatgcagcaaagcgatttggtatgtccgctcaagccgtattagatacgtgccaacgcctatatgaaactcatcgtttgattacttatccgcgttctgattgtcgctatttgcccgaagaacattttgccgaacgccataatgtattaaatgcaatttcaacccattgtgaagcttatcaagtcttaccaaatgttattttaactgaacagagaaatcgctgttggaatgataaaaaagtagaggctcaccatgcaatcattcctactgccaaaaatcgtccagtaaatctaacacaagaagaacgtaatatttacagccttatcgctcgccaatatttaatgcaattttgccctgacgcagaatatcgtaaaagtaaaatcacattaaatatcgctggcggtacttttatagctcaagcacgaaatttacaaacggctgggtggaaagaattgttaggcaaagaagacgacacagaaaatcaagaacccttattaccaatagtaaagaaaggacaaattttgcattgtgaacgcggagaagtgatgagtaaaaaaactcagccaccaaagcccttcactgatgcaaccttgctttcagcaatgacgggcattgcgcgatttgtgcaggataaagaactcaaaaaaattctgcgagaaaccgatggattgggtacagaggctactcgcgctggcatcattgaattactttttaaacgcggttttttaactaaaaaagggcgaaatattcatagcacagaaacaggaagaattttaattcaggcattaccaaatattgccacccaaccagatatgacggctcattgggaatcgcaactcacagacattagtcaaaaacaagcaacctatcaacaatttatgcataacttgaatcaaatattgcctgatttagtccgttttgtagatcttaatgcattaagacaattaagccgcattaaaatgattaaatccgatagagcgaaacctaaaagtgcggtaaaaaaatcgagtaaatcaaacggtgagactgattaaagttaaaccaattaatattttttttatgcaaagcacttgcaagaaaattgaattttctataacattcacgaccagttttcttgcaaaattgcaaattagagagaaaaaatgtatcaagttcttttatttatttatgttgttgtcgcgattgccttgatcgggtttattctcgttcaacaaggtaaaggagcgaacgcgggcgcatcttttggtggtggtgcatcaggtacaatgtttggctctgctggtgcaggtaactttttaacacgtactagtgcgattttagcaaccgcattttttgttattgctcttgttttaggtaatatgaattcacataaaggcaatgttcaaaaaggtacttttgacgatttatcacaagctgcagagcaagttcaacaacaagcagctccagcgaaagacaataaaaatagcgacatcccacaataaaataggattagcataaaattaacgctctggtggtggaattggtagacacgctatcttgagggggtagtgaccacaggtcgtgcgagttcaagtctcgcccagagcaccaaattaaaaatatacagcactaaaagcattacaaagccttgattctactgaaatcaaggcttttttattccctatactccactataaaatactatcgaaccttagaattttagtaatagacttaataatatattcacgctaaggcaaaaaaatcatagagacttgtaaataccaggattattacctagtttgctatattactaagtagggctattttatggcatacttaacaaatccgctttctgacacccaaattaaaaaagcaaaactgaaagaaaaagattgctcctacttttacaaacgattcacgaatacatccataactaaaaggactaagccctgtagattacagagcctagtccttgatttcatagtctaactttttcaatgaaaattattttttacattcaaagtgcggtattattccgcattgtttttcgatttaataatggcgtaaaccacacctgttgataaagcaccaatcgcaattgcaccaagatatttcaacggctcagacacaaatggaatgacaaataatccgccgtgcggagcttgtaaggtaatatttaatcccattgaaatcgcaccagccaccgcaccaccaatcacagagctaataatgactcgaattggatctgctgccacaaatggtaatgctccttcagaaataaaacataaaccaagaacaaatgatgctttccccgcatcgcattggctaacggtaaatttattgcgagcaatccaagtcgcaacagtcataccaattggaggaaccatacctgcggccattgccgcagccattggtgtataaacttgggaagcaatcaatccaaccgaaaaagtgtacgctgctttatttactggcccgcccatatcaatacacatcattgcgccgataattgcgcctaacacaatcgcattcacttcgcccattgaagtaagccaattacttagctctttcataatttcagccactggtggattgatgaggtaaatcatcgtcaaaccaacaatcatcgaacctaagagcggtaaaattaaaatcggttttaatgaagtcagactcgctggcaatcgaataatcacatttagccctttcaccacatagcccgctaagaaaccagcaataataccgccaagaatccctgcacccgcttcacttgccagcatccctgcaatcaaaccaactgcaagtcctggacgatcagcgatagaaaatgcaacgtagccagcaaacacggcaatcattaacttgaacgccacaccactaccgatatttatcaacatatttggaagatcttgaaaaactcctgtattttcaattacattaaaactgaacataaaggaaatcgcgatcaacaatccaccagcaaccactaacggtaacatatgagaaacaccagtcattaagtgtttgtacacaccttttttctcacggctttcttctttcgttcccgcattatttccaccatcaaaaattttggcttctttaaatgctttatcaaattcttgctcagttttctttaaggctaagcctgttgaagtgcggtacattggtttacctttaaatttatctaaaggcacgtcaatatctgctgcaacaaataccaaatcagccgctgcgacttcttccacagtaatttcattgccagccccaacttgaccacgggtttcaacttttacattccaaccttgctttttcgcataggcttcaatcgcttcagccgacataaacgtatgtgcaacgccagttggacaagcagttaccgcaacaatattttttacaccagaaacacctgtaaaactcaccgcacttttcggtgcaacataatcagccccattggctaaagcatttgccagcgtgacttcaggagaaatcatggcgatagcttcgccgataataaagacttttttaccaactaaatcggggttatttggtaatacagaaccaaatacgagaacaagatctgcttcggctggtgttcctacaatagagacatttgctttttgtgcagctgctcgaaaaacttcatgtaataaataggctttcacatcgcctacattagctgattgggttaaaaataacttcatactatccttcaatcatcgttatttgtactttttctaaaatagggtcaagtaaactcaaatcactcacaccgacgttactctgagatacagcaaaagcggacacagccgtagcaaaagctaaagtttctgttttcgataaacctttttcaaaaccatagattaagcctgctaccattgaatcccctgctccaacggtactcacgacattttcacattgtgctggttcggctttgagcacgccttcattattaatccataaagaaccttttgcgcccattgaaataatcacgttttcaatgccttccgctttgagttgctgtgcagcggcaataatttcttcaagactatttaatggatgaccaacccaagcctcaagttctcgatgattgggttttactagccaaggtttcgcttttaatccagcggtaagcgcagcattgctactatcaagcaccactttaacgccagcttgatgaagctgattcaaccaatcagcaaacaattcaggagacacacctcgaggtaaactgccacaaactgcgacaatgtcataatttaaacaataagccaaagaatccgtcacaaattgttgccaaacttgtgggcttatttgataccccaagaaatttaaatctgtcacatccgcttcagtctcggtaatttttacattgatacgcgttttgccatcaacacggtggaatttatcttccaaaccgtgctgattaaacatttgctcaaaatcagctgaattatccttgcccaagaaaccgcctactgcaacattaacgcctaaatcttttagtacttttgcgacattaatgccttttccagcagggaataagcccaatgtttctaccgtatttacttcgccaagttgaatacgatttaaacgcccaactaaatcataggcggcatttaaggtaatggttacgacgcttgccatactattcccctaaacccgattcgatcacagcaccgattccgtcaatagcttgttgcgcttcttcgcccgtcgcaacaaaacgtaaacgagtccctttgactacgcctaatgccacaattttcatcaaacttttagcactgactaattgagaattacgatcaaggttttgaactgctacggaagcattatatttcttcacttcgtttaccaatattgcacttgggcgagcgtgcaaaccttgctcgtttttaatcacaaatacggcttcaatggcatttgctggcaaattatcatcttctgttaccgcaggtgtgtgaatttgatcgcccataatctcaatggtatcgggttcagacggtggcactgccgaaacattctctcccaagccattggctatcgctttgcccaatgattcaattgcttgttttgcatcttccccctctgccacaaaacgtaaacgatgtccttgtgttacaccaagcgcaacaatcttcatcaaactttttgcgctgacgacttcactttcacgagtaagattttgcatggttattttagaagtgaattttttcacttcattaaccaaatttgcacttgggcgtgcatgtaagccgtgttcattacgaattgtaaaagttcctacaacagcaccttctacagattgagtttcaacatcactcgatgaacccaaaagtgcggtcaaaatttctgttgaatttccattgagcaaggttgtttggacatcgtcatctaataaacgcaccaaagttggattaatttgatcaccgacggctgaaacggttatcacgccttttacggccttgccattgtggctaaaaattgttttagcacgactaaatgctaaggcatttttcacatttcctacgacagagtccgttacccataaccctttgccaagcggtaatgccgcattatttatcacttcagaaataaagcgattttctaccgcactttgcacctgtaattgccccgcattaatcgcaactaaagttaataaactttgggtatttacatctaaactgatattggcagcaggaatttcaaatggatcaattgtctcgcccattaaaatcgcgcaaaattcagccacatcagttatttttgctaattttgctgcggtatcttcatcactcaaaacgtgggtaagttgacgtaataaggacaaatgctcatcagatcgcgccgcaataccaatcacgacataagcaatatttccttcgccccattctatgccttgaggaaattgaaacacttgcacgcccgttttctttaccatcaaacgagtatccaaggtgccgtgaggaatagcgatgccattgcctaaaaaggtcgaggtttgcagctcgcgcgctaacattccttgcaagtaaccattttcaacattgcctgcttgaaccaatgcggacactgccatttcgatcgcttgttgtttatcaattgcattagcatttaaatgaatgttgctttccgaaagttctaacattcttgctccttaataatttaaaaagaaagctgcggatgaaacaaatcgaccagcagcttattgaaaaacaattatttagatgtacaggctttcagcagcgcttcactaccttgcacaatatattcatcattttctccgcgcgcttcgcctttttgtaaatcacgcatcgcatcataaataccttgagccatactttgcgaatccactttttcccaacaatttgcgctcaaacgtttaaggttcgcttgcaatgcttccgcatgtaacacgccgctataataggcatatacatcagaatcatggccgcctgtataaagtttatcctgaatttgtttcactggaactaaaatacggcctaaataccagtcattcgcaccacttgcaaaattatctacaaaaaaattttcattcacgcgacctttatatgtcgccacagtcgcttcataagcagctgcataagatttttgatcgattttatctttatctaaatcaatcacttttttatcgttccccataaatggaatatagttagtaaccgatgaccaagaagaacaacctgccaatattaacgtaaaaaataaaacagagatttttttaaacatagtcatacccgattaaagttaataaaacgccgccattatactgtctaaaggggattaagcaaggaagcctgtaaggcttatctaggcaaatgttaatttcgtataaaatcagtaaaatcagaccattgctcaatacgaaaagcacgaatatctcgtaccgactgagaaatccacgccaactgttttagtgcattcattgcctgaaagagattcgccatatcttcattcatgttgatatataaacttccttgtgttctaacaaaaccaaattttgctaagactgcgccaatgtctgtataagcctgttgaacgccctttggatgataatcttgagtgtcttttacaactaaaaaagcaatcgcgtacataattttccttattcagcttcgggatcttcaagcaggtgagataagcgataaatgtctttttcaccagattgtaacaatgtgatattcaccaacacatcaccatctggcaaaaattccgcaacctcgccaaccacataaggcacgccaaattgcccgaattgcttaatacagcctgttggaatttgttgtcttagttccatatttaacctcaaattttttatggttttataacataattttgtagagaaatggataaaaatttaccgcacttctactcctgctcttttactaaagacaccaaaatctgatcgattttaaagttttccgtatcaatcacttcaaacttgtattttccgtaaaccacagaatcggtttttttcgggattttacgtaacatatacatcataaaaccactgatagtttcgtagttttcttcatcgggaaaataagcaatatctaatactcgagttacctcttctaatggcgttgcgccatcaatcagccacgagttttcatcacggctcacaatatattcttcttcgttagaaaccaattcccccataacaatactcatcacatcatttagcgtaacaatacccactacaagagcatattcattcacaataatcgcaaaatcttcgccagtagatttaaacaattccaacacttcgtaaagagaaagcgtatcaggcacaaataaggctttacgtagtagtttgggatcagtcagcaccacattttcattctgcaaatacattgtgagcaaagtatgggattcgatataacctaagattttgtcgaggccattgtcacaaatcacaattttagaatgagaatcacgagaaagcgtatccatgacttcttggcgagaaaaagtgcggtctaaatatacgatgttttcacgggttgtcattgtggaagttaccgtacgggcttgcatatcgaaaatattttcgatcaaataatgctcttgagtttttaatacaccagcttctgcgcctgcttcaactacggcgaaaatatcttcagaggtcatgccatcttcacgcacagtagaaatgcgaaataagcggaaaaatacattagcaatagtatcaaaaaaccacacaagcggtttaaacacatacatactaaaattcataatacccacaacgctcaacgccaccatttcaggataagtaatagcaattcgttttggaataagatcagcaaataaaataaacaaacaagtcactaatataaaagcgattgtagaggcggttggcgcaatccaacttccttcaaaagaacgatttaaaatatctgcaatgtaaggacttagcgcactttcgccaattcccccacccaaaatcgccaccatattcaacaaaatttgaaccaccgtaataaaacgaccaggatgctcttgtaatttaagcacttgaagcggacgcacgtcgcctttatttgcaagagattgcaattttaacttacgaggactcgccagagaaatttcagcagaagaaacaactgcgctacttaaaattaaagccacaattgccaaaatagtatgaaataattccataatcattactcaaaaatataaaagaaaacgaccgcactttgcgaccgtttgggatattacttatcgctgtcaaaccagccgcgaataaattggatagacaaaaataatgtcgccagcaagaatacatataaaatccacgaaacaatcggattgcttggtgtgtcatcagcagtaatttctttaattgaggttgcattacgatattcatccaccatcgtaatacgccaaccatagtatttaatttgcacaagtttgttgtcattacccaaagcctgtgcttcagcctgtaaattggctgagccaaatttgaagtagaatgggaaaccccaacgtgtatcttcgttgcgatacaccataattttaccatcgtcattttgcgtattgatgtaatacacatcacgtgttgggccatcagctggattcgattttgtgatggggccatccttatcaacacgtttaacttctacgccagtaacacgtgtcacatcgtaatgaggaaatacataattcactacggaaaacataaaaccgtggaataaaaaaacaacaataaataagaaatatttaaaaaactttcgcatacttttcccttgttagaactgtgcatttattctacacgaattttaaataaacgctcgaaattttgtgtagtgatttgagcaaacgcctctgcagaaacgccctttaaggttgccacgtattcacatacttctctcgtatacgctggttgattttcttttcctctgtaaggcactggcgcaagataaggcgaatccgtttccaccaataagcgttccattggtacataacgaataacctcacgaatcgcttcagcatttttaaaggtgacaatgccagaacaagaaatgtaaaatcctaaatccaacgcttttttcgnaaattccatagtttccgtaaaacaatgaataacgccaccgcacttttcagcacggtgttggcgtaacattgcaatggtgtcatcgcctgcagaacgtgtatgaataatcacaggcttatctaattggtttgcaatatcgatttggctaccaaacaccgcttgttgcgccgctttattgtccgcactgtaataataatctaagccaatttcgccaatagcaatcactttaggatcttgcgctaaacgcaataaacgttctgcgtcataaggttcttcttcaaaatcaagtgggtgaacaccacaagcaagcgagacattattaaattcccgtaaagagtcataagcctgctcaaaacggcttaaggttacaccaatcgcgagcaaatgtttcacatcacgtgcgtgcgctttttccaccacatccgagatatttttatgtaaattttcataatccaacgcatctaaatggcagtgggagtcaacaatgaacataattatttttccttatgcctaaggcttgaacgccatagacgatatatctttaatttattgcgtttcaaatacttctgtgactaatcgtgtcaagccatccaatagcattaattcaacattcacaccattaattgtaagcaaatctgaccgcactttttgcataattttaatggcttgtaataaaccaagggcagtttgctcgtcgctgaattgttcgataccacggccaagatcagccacttgtcgatgactatcaatttcaagtttatgttttaaacaatcagaaagaaaagccaaaatccaatccacttgctgaacatagcgttctttatcaaacaacggaagcaattccaatggcgaacgtcggcgatagaacacccaaaattgacgtaagaagtttttacgctgttcaataaatccttcttgtaacgtttctaatgctaaaagcggacgcccaagattcatcgcaagtgcggtcaaaatttcctgattttctaccgcactttttgattttaaccattcaaaagcaatttcttcattaggcacggaaagattccacacttggcatcgactgtaaatagttgctaacaaacttgccgaactatccgcttgaagtaaaaaataagtatttggacgaggctcttccaatgttttcaataatgcattagcagccgcttccgttaaacgttccgccccttgcacatacaccactttattgccgttttgttgtgcgtgctgcgcaaccatttcattaatgtcgcgtacttgatcaacgccaatatccttaccgttaatggggcttaattcgtgataatctggatggctatgggcttgcattaaatgacaagaatggcattgaccacaaggtttatcgccttgagctacacacattattttctgtgcaagtgcattaaataaactctctacgcctaaaccagaatcagctttaatcagcacagcatgatgccccaacccttcgtcaaaggtttgagcaatttgatgataaattggcattagccaagggtaaagtgcggtcatttttcgtttgatttccaccaattttttaccgcactttcaatatcagcttgaacaagttcaatactctgctctgcattaatcaccactgctttgggattatcttttactaattctaaatagcgtgctcgagtacgatggaaaaaatctaaatccatttgctcaatacgatctaactcgccacgtccacgagctcgcgctaaaccgacgctcggatctatatccaaataaattgtgagatctggctcaaaattacctaatacggtttctttcaaggtgagcataaaatgcgggtctaattgacgtccaccaccctgatacgcctgagatgacatatcgtgacgatcgcccactacccatttcccttgcattaaagcaggtttaatcacattttccaccaactgaatacgagccgcataaagcattaataactctgctttatctgtcacgggttcttcggtttcatgtttgatgagatgacgtaatttctcagccagtggcgttccaccaggctcgcgcgtaaacacaacatcttgaataccaagttcatgcaaaactcgcactacagactgatgagcggagcttttccccgcaccttctaagccctcaatgacaataaactttcctttcatattttcttccgcacttttatttggcatttttctgactgcgataccaacgtaaatattcttgcaccgctttgttatgttcattcaaatttcgggtaaatttatgcccaccagaaccatctgctacaaaataataaaaatctgttttttcagggttcgcaacagcctgtaacgaactttcacttggcatagcaataggcgttggcggcaatccatcaatcacatacgtattataaggcgtcttggtttctaaatcttttttgcgaatattcccattgtaattttcgcccataccataaattaccgttggatccgtttgtaatttcatttttgcttttaaacggttgataaatacagatgccacttttgccctctcattagcaatacccgtttctttttccacgatagaagccaaaatcaacatttcataaggattcgctaaaggtaaatcctcgtcacgctcgttccaagccttatttaacgcctttttcattcgctcagccgatcgcttaagtagctctaagtctgtcgatttaggcgtatagttataagtatcaggataaagccaaccttccacattttttagttcaagattttgaccaatatcaggcaaatcaagtaatgcgaaaatttcttcgttactcttatctttcaaggtttgcaccaagtgcggtgcattttcaagatcttttcgccaatctttaaaggtttttccttcaatccattttacattgaactgcacttctttaccggaattgagcaaatccagtaaatcttgcacagttttaacattctcaagagaataagtccctgcttttattttatttaactcaggtttcaacttcagcaaataaggtaataatttcccatcagcaattaacttttcttgctcaaaaagtgtggctaattttgaacttgttgtgccacgttcaatcgttaaaagttcatctgcctgcacatttactggtgtttttacaaattcagtcattttgtaataagaaaaactcgccacgcccgctaaaatcaaaattaaaagtaaaatcgcaattaaaaatttcttcataagctataagaaagagaaaataaaaaacaacaaaaggggcaattaagcccctttatttttgatactttgttatttattaaaatactgaatattcgctcttttacgcaatgctttaacccaatcgttcgtcgcatcttgtaattgagtatttactaaacgttcatatgctttttgtgtgtaggcttctgctgtaagatcgccatcacgtacgccagttacttccaaaatatgccaaccaaactcagttttaaatggtgcagaaatcacaccttgtttacttttcacgacggtttgtgcaaactgtggtgcataagtttctgggaacgcataacctaaactaccgccattcgcacccgataaataatctttagaatattttaatgcggcatcagcgaaagttgttttacctgcaataatatcagaacgaattttagctaattgtttttttgcttgagcatcatttaacaatggattaagttttaacaaaatgtgacgcacttcgtattctttacctgtaactttttgtgcagtgccttgtgattttgcctcatccaacattttttgaccaagtgcgacaacttcttcacgcgttacatcaatgctttcttgaatagctttgttacgtacagcccccatcaccatttgattggcaatttgctgacggaatgtatttaatgaaatgccttgataatctaacgcatccaaaaattgaccataagttaaaccatttctagctgcggtatcttccacaatatgatcaatttcacgcggatcaattttgactcccgattcttgaactgctttttgcaccaaaatatcatcaataattttatcaatcgcactttggcgatcaccttttttacccatattggcacgcacttgactttctaaaacaggaataccatccactgttgctacgacacgttcctccgcttgtgccatagaagtaaaagcaacacaacctaaagtagccaataaaaaagatcttaaaacaaattttttcattttcatctcatccaaaaaagagtcaataacgttggttagagtaacaattctattgaaggttcacaatagataagatttatttccctagaatagcaacttcgtaacagccatcttgtttttcagtgcgaacttgcacaagttcatcacggcttgttggcacatttttacctacgtaatcagcacgaatgggtaattcacgatgaccacgatcaacaaaaatcactaattcaatttttgcagcacgaccaaaatcagtaagcgcatccattgccgctcgaatggttcgaccagtaaacaacacatcatcaaccaaaatgacggttttatcttgaatattcaaatattgtgatgaaccactataaactggcattttatcttcctgatcaaccaaagttaaatcatctcgataaaaggtaatatccagttccattgaaggtaaatttatactacttaactcttcaactcgacgttgtaataattctgcaatttccgcgccacgtcgtttaatcccaacaatcacaagatcatctaaggtttgatgtttttcaataatttcgtgagaaatacgcgaaattgtgcgaagaaaacgatcatgatcaataataattttttccatttttcccagctttatcaatagtatttcaatgcacaaagtataaagaaaatacgcctaaaaagcgacggcatttgcaccatttttcttgttcgttatactatccaaaacattccatcaaaggaaaccaaattatgcgctactccattcaagattttattcaactcatcgcccaacttcgcaatccaaatggcggatgcccttgggatttaaaacaaaattatgaatctatgatttcttgtttaacggaagaaacttacgaagtaattgaagccattgagaaaaaagacataccaaatttacgcgaagaattaggggatttattgttgcaagtcgttttcttcagtcagcttgctagggaagataaatactttgcttttgacgatgtattgcaagatgttgctgaaaaaattgtacgccgtcatcctcatgtgtttggtgatgcaaaagcgggggacgaaacagaagctctttcccgttggaatgaaatgaaagcgaaagaaaaacaaggtaaaagtgaagaaacctctattttagataatgtgcctcgtgctttgccttctcttacgcgagcggcaaaattacaaaaacgttgttcaaaagtagggtttgattgggaagaaatttcacccgtatttgacaaagtgcgggaagaattagaagaagttcaagctgaaattaaccgcacttcgattgaacaaaataaagtggaagaggaaatcggcgatttattgttcgcaaccgtcaatcttgctcgccacttaaaatgtgatcctgaagatgcattgcggaaagcaaatttaaaatttgaacgtcgttttcgagcagtagagcaagcggttcaacaacaaggtaagcaagtgaataatgtgccacttattgaattagatttgttatgggatgaagtgaaaaaacaagaaaactaattgaaaagtgcggtaaaaatttctctcattttttaccgcactttcttcgttaaagttgctgaatatccagtgccatttggtctaacatttcataacgtttacgatacatagaacgttttttacttgcgatatcttctaattgtttgcgttcaatatgcaaaggtaattgccaatagttatggcgatattctccttggttttcttgccaaaattcatcgtaattaaacaaaatcttactgcgcgcagaaagacgatattttccttgtgctttgtgcggaatgcccactaactcacattgccatttttcagcaagcattttgaacccattaaccaacataaacattggtcgcataccgtgtaatgcttttgtagcctgtttcacaagttcttgcgcattgtcgcttgaggggccttgaatcgaggcgataagcaatttattcgggcttaaaaaagtgaaagacgaatcatatactcgttcgttattttgattgcgaatattaatagaaaaatatccttcaaagggatcgatatgattaatactcaacgataaacgcaaatcctcagttaattgggttagcacgatatgttgttgatctaataattgctgacaaagcgaacgtcccattttttcttctgccaaacgtaaattctccgtaatcgccgttaaacgttctgaagcagaaaaacgtttatcgcaaaaggtcgtcagaattgtattagtacgataataatcttgtgtaaataaagactgccattgcgtttctgtattaagaaaatccactaattggctacattgcttttgatataaccatttatagccataatagcgtaatttttcccgcacttgtttaagaaaagggcgatccttagaataaggatacatttgaacgtaagtggggaaaataaaatgatttttcgtggacataactcaatattttgtgaaatttaataaaatttttcattattttagccattatcacttcatttgccaaaattcttttttgtttaaaacccactttataactcagattttgttataatcttttccttgaattcctttttccctaccccaatatttacccaaattatcggaacgaaattataagagagaccaattatggcgaagaatacccaacgtacaatgcccgtattgccattacgcgatgttgtcgtttttccttatatggtgatgccactttttgtagggcgcgcaaaatcaattaatgcccttgaagaagcgatgaacgatgacaaacagattcttttggtatcccaaagagaagctgatttggaagaacctacccctgaagatttatttgatgtgggtaccattgctaacattattcagttattaaaattacctgatgacacagtaaaagtgctagttgaaggtcaaaatcgcgcgaaaattaacagtcttgaagacggcgaaaagtgcttttccgcccaaattacccctatcgaaaccacttatggcgatgaaaaagagttagtggtggcaaaaagtgcggtactttctgagtttgaaaattatcttaccctcaacaaaaaagtgcctacagatattctcaatgcccttcaacgtattgatgatgttgatcgcttagctgacacaatggctgcccatctccctgtaagcattcgccataaacaaaatgcgttagaactcgctaatgtgcaagaacgtttagaatatttgcttggtatgatggaatcagaggctgatattctccaagtggaaaaacggattcgcggtcgtgtcaaaaaacaaatggagaaaagccagcgtaactattatttgaacgagcaaattaaagccattcgtaaagaaatggatggtggcgaaaatgaagataccattgatgaagttgaacaactgcatcaaaaggtagaagcggcaggcatgccagctgatgtacgcgacaaagtagaaaatgaattacaaaaacttaaaatgatgtcagccatgtcttctgaagcaacggtaatacgcagttatattgaatggatgatccaagtgccttggcatcaacgttctaaagtgaaaaaagacattgttaaagcacagcaagttttagataccgatcactatggtttagatcgcgtaaaagaacgcattcttgaatatttagcagtacaagcgcgtttaaacaaagtgaaaggcccgattctttgtttagttggccctccaggtgtaggtaaaacttctcttggtcagtctattgccaatgctactggtcgtaaatatgtacgtatggcattaggcggcgtgcgtgatgaagcagaaatccgtggtcaccgtaaaacctatattggtgcattgccaggtaaattaattcaaaagatggcaaaagtgggcgtaaaaaatccattattcttgcttgatgaaatcgacaaaatggcatccgatatgcgaggtgatccagcatcagcattgcttgaagtattagatcccgagcaaaacaccacatttaacgatcactatttagaagtggattatgatctttctgatgtgatgtttgtggcaacatcaaactctatgaatattccaggcccattattggatcgtatggaagttattcgtctttctggttatacagaagatgaaaaacttaatatcgcaatgcgccatttattagcaaaacaaattgaacgtaatggtttgaagaaaggcgaacttaccgtagaagaaagtgcaattttagatattatccgctattacacacgtgaagcgggcgtacgtggattagaacgtgaaatttcaaaaatctgccgtaaagccgtgaaaaatttattagtaaatccaaaacttaaatctatcacggtaaattcagataatctgcacgattatcttggcgtaaaacgttttgaatttggtaaagctgacacgcaaaaccgcattggtgaagtgactggtttagcttggacagaagtgggcggcgatttactcactattgaaactgcctctgttgtgggcaaaggaaaactttctttcactggttcattaggcgatgtgatgaaagaatccattcaagcggcaatgaccgttgtgcgtgctcgtgcggataaactgggtatcaatgctgaattccacgaaaaacgtgacattcacattcacgtgccagatggtgcaacaccaaaagatggcccaagtgcaggtattgcaatgtgtactgcattaatttcttgtttaacaggtaatcctgtgcgtgctgatgtggcaatgacgggagaaatcagtttacgtggtaaagtattaccaatcggtggattaaaagaaaaacttcttgcggcacatcgtggtggaattaaaaccgtattaatcccaaaagaaaacgttaaagatcttgaagaaattccagagaacgtaaaacaaaatcttgcaattcatgcggtagaaaccattgatgaagtgcttggttttgcattggaaaatccaccagagggcattgagtttgttaaagtggaggctaaacctaaagcaccacgccgtaaagtgacgagtaaatcagaaagagcggtcaattaattgaatgttttagggcttgtgaaaacaagccttttattgattttagagatgataatttcatctttacacaaggttaatttatacttttccaaattgaaaacttgttaataacacaatgccaaaacttcctccactttccctttatatacacattccatggtgcgttcaaaaatgcccttattgtgattttaattcgcacgcacaaaaaagcgatataccagaacaagactatatttatcatcttctgcaagatttgcaggctgatttgcaacgctttaaagattctattcaacaacgaaaactccattcaatttttattggtggcggtacaccaagtttgttctcggcagaaagcattgcgtatctcttaaaagaaataaaaaaacagattgattttgaagataatattgaaatcacattagaagctaatcctggcacggtagaagctgaacgttttaaaggttatgtatccgcaggcattatgcgaatttctatgggaattcaaagtttcaatgatgataaattacaacgtcttgggcggattcataatgcagcagaagcaaaaagtgcggtcaatttagcgaaagtttctgggctaaaaagttttaatttggatttaatgcacggtttgcctaaccaaacgttggaagaagccttagatgatcttcgtcaagcaattgagctatctcctccccatatttcttggtatcagctgactattgaaccaaatacgatgtttgcttatcgcccacctaaattaccagatgatgacgcactttgggacatttttgagcaaggtcaccaacttttaacgatggcaggctaccagcaatatgaaacctcagcttacgcaaaagcaggttttcaatgtaaacataatttgaattattggcgatttggggattatttagccattggctgtggcgcacacgggaaattgacgtttccgactggcgagattactcgcttttctaaaaccaagcacccgaaaggttatttgcgtggcgaatatctttacgaagaaaaaaacgtgccaaaaattgaccgcccttttgagttttttatgaatcgctttcgtttgttagaagcggtacccaaacaagaatttgaagattacacaggcttgtcgcaaagtgcggtgaaaaatcaaattgattttgccattcaacaaaactatattgtggaaaacgctgattcttggcaaatcactgaacacggcaagttatttctcaatgaacttttggaattatttttaacggaagaatagcctaatcgtgaaataacctagtcgtgaaataacattgcttgagaaaaacgcctgttaaaaattacacttgtttattaaatactctcgtaataaagtaacacaatcgtttacttattaagataaggaaaagaaatgaatcaattagaaatgaaaaaactcgccgcacaagctgcattacaatatgtaaaagcagatacgattgttggggtgggaagtggctccacagtgaactgctttattgaagctttaggtacaatcaaagataaaattcaaggtgccgttgcggcttcaaaagaatcagaagaattattacgtaagcaaggtatcgaagtatttaatgcaaatgatgtctctagcttagatatttatgtggatggtgcggatgaaatcaatccacaaaaaatgatgattaaaggcggcggcgcagcactcactcgtgaaaaaatagtcgctgcattagcgaaaaaatttatttgtattgtggattcaagtaagcaagtggatgtgttgggttcaactttcccattaccagttgaagtgattcctatggcacgctcacaagtaggcagaaaattagccgcacttggtggctcacctgaatatcgtgaaggggtggtgactgacaacggcaatgtgattttagatgtacacaacttcagtattttaaatccagtcgaaattgaaaaagaattaaacaacgttgcaggtgtcgtcactaatgggatattcgcgttacgtggtgcagatgttgtgatcgtcgggacgcctgagggtgccaaagttattgactaattcataataaaaatcataaggaagcaaacatgacaaacaaagtctctctagacaaatcaaaaatcaaatttgtattgtttgaaggtgtgcatcaaagcgcacttgatacgctccatgcggcaggctataccaatattgattactataaaaaagcactagatggcgatgaattaaaagaagccattaaagatgtacactttatcggcttgcgttctcgcacccatttaacggcagaaatgattgaggccgcacccaaattaatcgctgtgggatgtttctgtattggcaccaaccaagtggatttaaatgcagcaaaagcgcgtggaattcctgtatttaatgccccattctcaaacactcgctccgtcgcagaacttgtattaggcgagattttattacttatgcgcaatgtgccacaggctaatgccgaagtacatcgtggtgtctggaataaatccgcgactggctctcatgaagtgcgggggaaaaaattaggcattattggttacggtcacattggttcacaattaagtattattgctgaatcattagggatggatgtgtatttctacgatattgaaaacaaacttccactcggtaatgccaaacaggttcgtagccttgaagaattactcagttcttgcgatgtggtttcattacatgtgccagaactgccatctaccaaaaacttaatgaacgtagcacgtatcgcacaattaaaacaaggggcaattttgatcaatgctgcgcgtggcacagtggtagatattgacgctctcgctcaagccttaaaagatgggaaacttcagggtgccgcaattgatgtattccccgttgagcccgcttcaattaatgaagaatttatctcgccgttacgtgaatttgataatgtgattttaacgccacatatcggcggctcaacagcggaagcacaagaaaatatcggttttgaagtggcaggcaaatttgtcaaatattcagacaacggatcaaccctttcttcggtaaacttcccagaggtctctttaccagaacacgagggaacaaaacgcttattgcatattcacgaaaatcgtcctggtatattgaacaaactgaaccaaattttcgtcgaagctaacctcaatattgcagcgcaatatttacaaactgacccgaaaattggttatgttgtcgtagatgtagaaacgaatgatgcatcgccattactgacgaaattgaaggaaatagatggcacaattcgtgctcgtgtactatactaaatagaaaaaagatcaggttaatgcctgatctttttttgctttcttattcagtaatcgaataaggtaactgcactcgctctaacaatatttcactattcagcaacctaaattgttgctctgaatcaatgtcgttattcatcacaacttgcaaccataaaacaccgtctaaattgaccgcacttgtaatcgtgccagtcttacgccaattagcttcaagctgcatttcaatttcactgccaatttccgcttcctgctgggtttgcactttaaaaataaacattgcgcgtttattcgcaccacgatatttcgcacgtgccacggtttcttgcccaatataacaacctttggtaaaagaaatggcttgctcaatagcctgtaaatttagggcttgtgggataaattcattttgcgtttgaggacttaaatttggcaatcctgcttgaatatcagctacttcccaaattttttcatcgccattaaaattcacgggcaattcagtttcatttaataaaattgaacgtttttcatcaatttctaatgaaaagttcggtgtaatttttccacatttttcacctattacgccaatgatttgccaatcacgtaaatcaaaactaactttggaaaataccgcatattttttcaaagcatctagaccgcttggcaaaatatctttcttaacgagtaaaaagaattgttcactacttactttaaacaaacgataaattgcattcattttaccttttgggtcgcagtgagctgtaagtgtcgttgcgccacttgctaatcgcacaacatcagaagttaattgcccttgcaaatatttttctgcatccgcaccctgtacttcaatcagctgatattgagtaagagaaataaattgagacattctgttttcctattctaaattctgaatttgctcacgcatttgttcaataagcacttttagctccaccgcagaagccgtgatatctgcattaatggatttagacgcaagggtattggattcccgattcaattcttgcatcataaaatctaatttacgtccaactgcaccgccttttttcaaaatattcgtggtttctttcacgtgcatttgtaaacgatctagctcttccgccacatcaatgcgttgagcgagtaaaatcatttcttgttccacacgttgcggatcaagattaagttgagcatcttcaaaacgttgcaataaacgttcacgctgccattgtaaaactgctggcatttgtgaccgcactttatccgtttccactgcaatggaatctaaacgttgttgaataatatcgttcagtttttccccctcacgaccacgcattgcaataaaatctgtcagtaaatcatcaaaggctgtcaataaatcttgactaatcgcatctaaatcttgctcttgcgcttccactacgccggggtaacgcaacacgtctgtcaaattaatttccccttctccagcctgagctttaatccattgcaaagattgaattacttgattcgcaagttctttatttaaattcaattctgcatttgcttgtttttttgtttcaatgcgtagagaacattcaattttaccgcgagtaagattttgacgaagtttctcacgcaacgtgttttctaatccgcgaaattgctcgggcaaacggaaaaagttttctaaataacgttgattaacggaacgaatttcccataccgcatcaccccaatcttttttcacttcaaggcgtgcaaaggcagtcatactgtaaatcataagctctcctattttctcttagctttgtcttagttgattcgctaagtattgtaacgagatgaacacagaaagggaaaagaaaattaacacaataaaaatctggaaaattatacctcttaagtaaacatttttgataaattttaacgatagtaaaaatgtactaaaaacacaatttttttcaaaaaaattgctttttttaattttaaagtgtatttttaaggcaatataagatctaataacatttgagcgagcatatacaatatgaattttatctgcacttaccatcatcaccacacctgattatctttcaggcgtgattgtatgtttggaagataataaaatatcttccgagtgtaataaaaatcagtgtaaaagcaataaatacccctcggaaggcaattttcgaggggttttcttttatctcaactttaaaataggaaaaacattatgacaaacacaacaatgcaaccaaaccgccttcgtattgctttgcaaaaaaaagggcgtttaagccaagattgtgccatattacttaaacaatgtggcgtgaaaattaattggaatgaacaacgtttaatcgcttatgcggaaaatttgccgattgaaattcttcgcgtacgtgatgatgatattcctggattgatttttgatggcgtagtggatcttgggattattggcgaaaatgtgttagaagaggaagagcttggtcgccgtgcagcaaatgaaacagttacatacaaaaaacttcgccaacttgattttggtgattgtcgtctatcacttgcggttgatcgcgattgtcattatgagaatgtgaaagatcttgctaataggcgtattgcaacttcttacccgcatttgctcaaacgttatatgaatgagaatggggtgtcgtttaaaagttgtttattaaatggttcagtagaagtcgcacctagtgcgggtattgcttatgcgatttgcgatttagtatcatcaggggcaacgcttgaagcaaatggcttaaaagaagtggacgtgatttatcgttctaaagcttgtttaattcagcgtgctgaaccgcttgaatcaactaaacaagctcttgtggataaactactcactcgtattcaaggtgtgcagcaggcagcagaaagtaaatatattatgctccacgctccgaaagaaaaacttgaaaaaatcaccgcgcttttacctggcgttgaaaatccgaccattttaccattagccagtgatacaactcgggtagcaatgcacgtagtgagccaagaaaatttattttgggaaacaatggaacagttaaaagaggcaggagctagttcaattttagtgttaccaattgagaagatgatggagtaaatgtagtgcgagctttgactcgccatttaaataatcaatatctcaaaatgctgggttatcatccattttacggatacaaaggaaaataaacaatgcaaacaattatttggaatcatttatcagaaactgaaaaacgcaaagtcattatgcgtccagtccaacaaaatgggaaaaacattcagcaggcagttaatgccattcgtgaaaatgtggcatacaatggcgatcgggcattatttgaactctgtgaaaaatttgatggcgtgaagttagataaactcattgtttcggcagatgaaattcaagcggcaagtagtcggatttctgtaaaacttcgcaatgcgattgagcaagccaaaacgaacattgaagcctttcacaaagcacagcaaaatcaggaaattgacctagagatccaagaaggcgtgcgttgccaagttgtgactcgtccaatttcttgtgtagggctttatattccgggtggttcagcaccgttgttttccaccgtattgatgttagctattcctgctaaaattgcaggttgtaaaaaaatcgtgctttgttcaccgccaccgatctcagatgaaattctctacactgctcatctttgcggtgtggaaactatctacgctataggtggtgctcaagcagtttttgcgatggctcaaggcacggaaagcgtggcgaaagtagataaaattttcggacctggaaacgcatttgtgacagaagcaaaacgtcaggtagcacaaaatagtacggcgattgatatgcctgcgggaccttcagaagtgttagtaattgcagatgaatcggcagatcctgaatttgtggcaagcgatttactctctcaagcggaacatggggcagatagccaagtgattttggtggcgacctgtgaaactctggcaaaagagaccgcacttgcgattgaacgccaacttgctctattacctcgtgctgaaaccgttcgaaaagcgttaaaccacagccgtatttttatagcagaaagccttgaacaagcggtagaaattagcaatgaatatgcccctgaacatttaattgtgcaaacaaaaaacgcccgtaaattattaccatatttagataacgcaggctcaattttcttaggtgcatattcgcctgaaagtatgggcgattatgccagtggcacaaaccacgttttgcctacttatggttacaccaaaacttattctagtctaggattagctgattttagtaagcgaatgacagtacaagaactcacaccaaaaggttttaaaaaccttgctgaaacggtggaagtgatggcagaagctgagcaattggcagcacataaaatggcagtaagtgtaagattggcgaaactcaatatctaagatattaattatagatctaagcacgacacgtaagcagtcaaattttcatacaacaatacgaaatatgtatgaatgattacaattcgcacattttacaatggaagaaaacaataatgacaatcacaactttatcccgacaaaatatacaagccttaacgccatatcaatccgctcgaaaactcggcggcaatggtacgatttggctgaatgcaaatgaatatccaacttcgcctgaatttcagctttcgggtaaggatttaaaccgctaccccgaacctcagcctcaaagagtggtacaggcttatgcgaattatgcgggcgtttcaactgaaaatgtactcgttactcgtggcggtgatgaaggcattgaattgataatccacactttttgcgaacccaaacaagatgccattttattctgtcctccgacttacggaatgtatgcagtgagtgctgaaacggcaggtgtgctaagtaagaccgtgcctttaactgacgattttcagcttaatttgccagaaatcaaaaatcatcttaatgatgtaaaagtagtctttgtatgcagcccaaataatccgacaggtaatttgctcaagcaatcagatatactcgatcttttgcaaatcacggcaggcaaagcgattgtggtggtggacgaagcctatattgagttctgtcctgaagcaagcgttattaatttgcttaaaaattatccgcacttagcaattatccgcacgctctctaaagcctttgctttagctggattgcgttgtggttttgtgttagcaaaccctgagctaattgacatcttaagtaaggtaatcgctccatatcctatccctgtgccgagtgctgatcttgcggaacaagcgttaagaccttcgaacatcgccactgttcaagctctcacacaagaacttctttccaatcgtcaatggcttgctaaagctcttttagttttacatcaagtggaaaaagtgtatgaaagtgaagctaattatctgttgatcaaatgtcaaaacgggcaagctgtgtttaaggcattgtgggaacaaggaattattttaagagaccagaataagacattgcatttacaaaattgtattcgcattactgtgggaacaaggaatgagtgtgagaaagttgttgaagcaattaaggaggtaaaatgaaccacctcctatttaagtcacagagcgattcgagattatttagttttatactgtttgtataaagcaaatgataaacctcataccattcatataacatacacggagaaaaatatgcaacctactctttttatcgaccgagacggcacattaattgatgaaccaaaaactgatttccaaattgacagtttagagaaactaaaattagaaccgaaagtgattcccgcactcctcagactgaaagcgaaataccgttttgtgatagtttctaatcaagatgggcttggtacggatgcttttccgcaaacagattttgataagccccacaatgtaatgatggcattatttgaatctcagggcattacctttgatgaagtactcatttgcccgcataagcccgaagaaaattgtctatgtcgcaaaccaaaaattaagttgcttgatcactatattcgtaaaaatttattcgatattgaccgctcttttgtcattggtgaccgagagaccgatgtgcaattagcagaaaatctaggtattcgagctattcaatacgatccacagaaaatgaattgggatctgattgcagaaaaattgttgggggaaacggtcacaaactgtggcaaacgtccgccacgttttgcagaagtaattcgtcaaactaaagagaccgatattaaagtgcaggtttggctagatgaagctggtgtaaatgaaatcaaaaccggcgttggtttttttgaccatatgctcgatcaaatcgccacacacggtgggtttagaatgaacgtgcagtgtaaaggcgatttatggattgacgaacatcacacggtggaggacaccgctctcgcccttggacaagcactgaaacaagccgttggtgacaaacgtggtattgcccgtttcggctttgtgcttccaatggacgaatgtaaagcagaatgtgctttagatttatcgggcagaccttggatcaaattcaatgcctgctttaaacgcgataaagtgggcgattttagtacggaactcactgaacatttctttcaatctttggcattttcaatgcttgccacgcttcatttaaatgtcacaggtaataacgatcatcataaaatagagagcttatttaaagcctttgggagaacattaagacaggcgattcggattgaaggaaatgaaatgccaagttcaaaaggagttttatagttgaaagagcggttaatttttgtcgtatttttgcaaaattcgaccgattgtaaaaggataaaaaaatgataaacatcacgattatagacacaggttgtgccaacctttcttctgtaaaattcgcctttgaccgattaggttacaataccgagatcacttttgatctcaataaaatcaaatctgccgataagctgattttacctggcgtaggcactgcaaatgcagcaatgtataatttacaagaacgtcaattgatcgagaccattcaaaatctaacacaaccagtgctaggaatttgtttgggtatgcagttaatgaccgaattttccgaagagggtaatgtgccgaccttaaacctaataagcggaaaaactaatcgaattcccgatacgggtttaccgttacctcaaatgggatggaatcgcgtgcaatttgtaaaaaactgtccgttatttgatggtattgtgcaaaatagtcacttctattttgtgcatagttatgcagttagcccgaatgaacattcggtggcaataagcaattatggtgtgaatttttctgctgcgatagcgaaagagaatttttacggtgtacaatttcatcctgaacgttcgggtaaaaatggtgcgttgttgctaaaaaattttgtggaaaaagtaccgttttaatcactagatcatatagtcatacaggatcaaacacaatgaaacaatctattattattcctgctcttgatcttatcaatggtcaagttgtgcggttacaccaaggcgattatgccaagcaaactacctattctgacaatccaattaagcaatttgataattatgtacgtcaaggagcaaaacaactacatctagtcgatttaacgggagcgaaaaatccccagtcaagacaaaccgcacttattggaaaaatcgttgaagcaacacaatgtaaagtacaagtgggaggaggcattcgtacagagcaagatgtggcagatttattggctgtgggtgcgaatcgcgtggtgattggttcaaccgccgtaactcatcgttcaatggtgaaaaactggttcatcaaatatggtgcggaaaaatttgttctagcattagacgtgaatattaatgcaagcggtcagaaaatcgttgcgattagcggttggcaggaagaaagtggtgtactattagaaacgttgatcgaagatttccaaaccgttggcttacaacaagttttatgtaccgatatttcacgcgatggcaccttgacaggttcaaatattggactttatcaagaaatttgtgagaaatatccacctattcagtttcaatcttctggagggattggttcactggctgatattgaggctctaaaaggcacaggtgtgtcaggtgtaattgtaggtcgagctttattagaaggaaaatttacgctttcggaggcaatcaaatgttggcaaaacggataattccttgtttggatgtacgtgatggacaggtggtaaaaggggtacaattccgtaaccacgaaattattggcgatattgtgccacttgctcaacgctatgcgcaagaaggagctgatgaattggtattttatgatattacggcttcatcagacggtcgtaccgtggataaaagttgggtagaacgaatcgctcaggtaattgatattccgttttgcgtagcaggtgggattaaaaccattgaagatgcggaaaaattgtttgcatttggggcggataaaatttcgattaattcccctgctctcgctgatccaacgctcatttctcgcttagcagatcgttttggcgtacaagcgattgtagtaggtattgatagttggtttgaacaggaaacaggtaagtattgggtaaaccaatatacaggcgatgaaacacgtacccgacaaactcattggcagttgttagattgggtaaaagaagtacaacaatgcggtgcaggagaaatcgtgctaaatatgatgaatcaagatggtttacgaaacgggtacgatttagcccagctcaagctggtgcgaggagtatgtagagtacctctaattgcatctggcggtgcgggtaaaatggtacattttcgtgatgcttttattgaagcaaaagtagatggggcattagctgccagcgtattccataaacagattattgaaattggcgagttaaaatcctaccttgtgcaatcagccatcgagattcggagtgaataatgaatattactaaaatagactggcaaaaagttaatggtcttcttcctgttattattcaaaatataagtactcgtgaggtactaatgcttggctatatgaatgaagaagcccttacaaaaaccatcaaagaacgtaaagtaactttcttctctcgtaccaaacaacgattatggacaaaaggagaaatctcgggcaattttttaaatgtggaagaaatgagcttagattgcgataacgacactttgctcattttagttgatcccattggggcaacttgccacacaggtgaatacagctgcttccatcaatttacctctccacaatcagagaacaagaagcaacaatttgcaaattgggcgtggtttataaaattagaacaacatttaaaagaaaagaaaaatgcagatccttctaattcttatactgcaacattacacgcaaaaggtaccaaaaaaatcgcccaaaaagtgggggaagaaggtgtggaaactgccttggctgcggtcgcacaagataaagcggaagtcatttctgaagctacagatttggtctatcacttaaccgtattattacacaatcaagatcttcagtggtacgaaattatcgcaaaactacaagaacgccatcaagggattggattacatccagaaggaggaaataaataagaaaattgtcaggcaatattaagtgagcaattagaagatttgtttgggcaattcaatatcatcgtaaaatacagtgaaactatggtaattaaatgtattgataaacaacaaaatttaggaaatatcattttattccttcttcttaagcaacaatatagcaaggaagatagtaaaaaattcacaatttataaattttatttacagactgtaaattatacaatacaattatcgtaaattttttattacatcataaggaaacaaaaatgaacaaaactgtaggcagcacacttcttgttgctggtacgatgattggcgcgggaatgttggctatgccactcacttccgctggcattggcttcggctttactttagtcttgttattggggctttgggcattattaacttttagcgcacttttattcgttgaactctatcaaactgcggaaagtgatgcaggtatcggcacacttgcagaacaatattttggtaaaacaggacgcattattgccacagccgtgctaattattttcttatacgcattaattgccgcttatatcagcggtggcggttcactactaaaagatttattaccagaaagttttggcgataaagttagcgtcttattatttaccgtgattttcggttcatttattgtcatcggcacacatagcgtagataaaattaatcgcgtgttatttttcgttatgcttgctgcctttgccgtggtgttaagcttaatgttgccagaaatcaaatttgataacttaatggcgacgccaattgataaggctttaattatctctgcaagccctgtatttttcacggcatttggtttccacggttccattccaagtttaaataaatacttagatggcaatgtaaaagcattgcgcttctctattttggtcggctctgccataacactttgtgcttatattctatggcaactatccacgcacggcttgcttacacaaaatgaatttttacaaatcttaaaagaagatgcgactttaaatggcttagtaaaagcaaccttcgccatcactggaagcaatgtgatcgcaagtgcggtaaaattattttctacattagcacttatcacttctttcttaggtgtgggattaggattattagaatgtattgaagatttactaaaacgttcatttaacgttacagcaggtagaatttcacttggtttactgacttttattccaccacttgtttttgcattattttacccagaaggttttattttagcactaggctacgcaggtcaaatgtttgcattctacgccgtagtattgccagttagccttgtttggaaagctcgtcgtgcccacgctaatttgccatacaaagtgtggggaggaaatctgactttaattatcgtattggtattaggcgtgctcattacatccattccatttgcgattcgtgcgggttatttaccctttgttgtaggttaaaaacaaactaaaaatttaccgcactttttatctaaaaaagagtaaatattgtcctaattaatttagataaaaatttcagacaaaacttatcattaatcttatacaacaaaaaggctaagttctaaaattatagaacttagcccttaaactaaatgaagttcacttcatctatattatactttcaattatcgtcttgttttcaatagtttttcagtgagttcataagctcgaagttttgctaactctttagaaagttttgcaacaagtaagtcgtgatctgcatcagatccgcgagatactatattttcttctgctttacgttttgcttcgtgaatacgatctgcatctaattcactacctcgaatagcaatatctgctaatactgtcacaatatttggttgaacttctaaaaaaccaccagaaacatagataacttcttcattcccatctttaagagtaaatttaacaatcccaggcttaattgctgttagcaatggcgtatgtccgggcaaaataccaagctccccttccacaccagttacctgaatttgttttacttcaccttcaaagattttctgctctgcgcttactattgttaaattaaatgtcgccattttgttctccttcaaatgacttgaagtgattacatatttttggctttttctaacacttcatcgattgaaccaaccatatagaacgcttgttcaggaatatggtcatattcgccatctaagatacctttgaagccacggatggtgtcttttaatgtcacgtatttacctggtgaacctgtgaagacttctgcaacaaagaatggttgtgataagaaacgttcaattttacgtgcacgtgctaccactagtttatcttcttcagataattcatccataccaagaattgcgataatatctttcaattctttataacgttgtaaaataccttgtacaccacgagcaacatcataatgttcttgaccaacaacaagcgggtctagctgacgtgaagttgaatctaatggatcaactgcagggtaaatacctaaagatgcgatttgacgacttaatacaacagttgagtctaaatgtgcgaaagttgttgctggagatgggtcagttaagtcatccgctggtacgtacaccgcttgcacagaagtgatagaacctgttttggttgaagtgatacgttcttgtaacacacccatttcttctgccaatgtcggttggtaacctaccgcggatggcatacgacctaataacgcagatacttccgtaccagcaagggtataacgatagatattatccacaaagaataatacatctcgaccttcatcacggaatttttcagccatagttaaaccagtcaatgcaacacgtaaacggttacctggtggctcgttcatttgaccataaaccaaagatactttatctaatacgttagaatctttcatttcatgatagaagtcattaccttcacgagtacgttcgcctacacccgcaaatacagagtaacctgaatgctcaatcgcaatattacgaatcaactccatcatatttacggttttacctacacctgcaccgccgaataaaccaactttaccaccttttgcgaatggacaaattaagtcgatcactttgataccagtttctaataattccgtactgtttgattgttcttcatagctcggtgccgaacggtggatagcccaacgctcttcttcaccaattgctccttgttcgtcaattggttcgcccaacacattcataatacgaccaagtgtttttgtgcctactggtacttgaattgggttatttgtgttttctacttttaagccacgttttaaaccatcagatgtacccaatgcaatacaacgaactactccgccacctaattgttgttgcacctcaagtgttaaacctgattcaacttttaatgcatcgtaaacttttggcactgcatcttgtggaaattcaacgtcaatcaccgcaccgatgatttgtacaatttttcctgctgacattaccgttcctcttttcttaaatcgccgccgcaccggctacgatttcattcaattcatttgtgatacttgcttgacgagctttgttgtacaccaaccgcagatcattaattaaattacctgcattatccgttgctgctttcattgctaccattcgagccgcttgttctgaagctacattatctacaaccgcttgataaatttgggactctaaataacgaactaaaaggctatctaatagtacttttggttctggctcataaagataatcccaagtctgttgtctttcatttaaatgatcgtctttagattctggtaaaggaactaattgttgtacaacaggcttttgcgacatcgtattaacaaatttattgtatgcaatataaactgcatcaatttcaccattacgataagcatcaaacattgtatttgccacaccaattaattcttctagagcgggcgtatcgcctaaaccagaaagctgacctttgatattaaatccaaaggaacggaaaaaactaatcccttttgaacctattaagcccaaatctgtagaaatattttgttctttccaattttttatttggttaagtgtggttttgaataaattaacatttaacccaccacacatcccacgatctgttgaaataaccaagataccgattttcttcacttcgcgctcaactaagaacggatgtttataaccgatacttgccttagacacatgactaataacgttacggatagtttcagaatacggacgagatgcagccatacgatcctgcgttttacgcattttcgaggttgccaccatttccattgccttagtgattttttgtgtactttgtacactggcaattttggtttttatctcttttgcacctgccatcttatctctccgttactaccaagcactattcgctttaaaaccatctaaaatactttttaaagtatctttgatttcatcattatagttaccggttttattaagctcttgcataaattcagcgtgattacggttagaataatctaaaagtgcggtctcaaaacttgcaatttttgataattccacgtcatccaaataaccaaattcaacagcaaacaatataaccgcttgttctgcaacagataatggcgtgaattgtttttgttttaataattcagttactttttcaccgtgagaaagttgcttacgagtcgcatcatctagatctgatgcaaactgtgcaaacgctgctaattcacgatattgagctagcgcggtacgaataccacccgctaatttcttaataactttagtttgcgctgaaccaccaacacgagataccgaaatacctgggtttaccgcaggacgaatacctgagttaaacaagttagattctaagaagatctgaccatcggtaatagaaattacgttggttggaacaaacgcagatacgtcaccagcttgggtttcaataatcggaagtgcggttaaagaacctgtttttccttttacttcgcctttagtgaatttttctacataatcttcatttacacgagaagcacgttctagtaaacgagaatgtaaatagaacacatcacctggataggcttcacgacctggtggacgacgtaataataatgaaatttgacgataagctacggcttgttttgataaatcatcataaacaattaacgcatcttcgccgcgatcacggaaatattcccccatcgcacaaccagcataaggggctaaatattgtaacgctgctgattcagatgcagatgcagctaccacgatagtatttgcaagcgcaccatgttcttctaatttacgcacgacatttgcaatagtagaggctttttgaccaatcgcaacatagatacatttaatacctgaattacgttgattaataatagcgtcaattgctaacgcagttttacccgtttgacggtcaccgatgattaactcacgctgaccacgaccaatcggtaccatagaatcgacagctttataaccagtttgaacaggttgatcaacagaacgacgatcgataacacctggcgcaatcacttctactggtgagaaaccatcattttcaatttcgcctttaccatcgattggctgaccaagcgtattaactacacgacctaataaaccacgaccaactggtacttcaagaatacgacctgtacattgaacttccataccttccgctaaatctgcgtaaggtcccataactacagcaccaacagaatcgcgttcaaggttaagtgccatcgcataacgattacctggtaaggcgatcatttcaccttgcatcacatcgcttaaaccgtggatgcgaataataccatcgcttacagaaacaattgtccctgtattacgcgcttcactgaccacgtcgaattgagcgatgcgttttttaatcaattcactaatttcagttgaatttagttgcatcttgtattcctcttataattgcaactcgtttgcaagacgagtaagttgcccacggctacttccgtcaatcacaaagtcttcagtacgaacaatcacaccagcaataagtgcgttatccacgttgcaatttaatttcactttgcgagctaatcttttttccattgcagctgcaattttttcgatttgtgttgcattcaatggttgcgcagatgttacttcaacttctgcaatagcttggtgttcctctacgtgatgtttaaattcttcaaacaccgcaggaatagcactcaaacgcttattttcagccattaaccgaataagattttgcccatattgatccaattgttcgccacaaatagaaattactgtatcagctaatttctgtgcagaaagagaactacttaagtaagcttttaccgtttcatcttcagctacggcagcagcaaaacctaacatttcagtccatttttcgaccgcactttgttcaatggcaaagtcgaatgcagcttttgcataagggcgagctattgtagttaattctgacataagctaagcctcttataactctgcaactaatttatcaataatgtcattgtttgccgcttcatcaatagaacgacccacaattttctcagcaccagccactgccaatgaagctactttaagacgtaattcttcttgaacacgtttacgttctgcttctacttcagcataaccttgtgcaataatttttgcttttagttcttcggcttctgccttcacttcgtctaatacttcattgcgacgtttattcgcagcatctaaaatgtcttgagcttgtaattttgcagctgaaagttcttgttcaacaagatttttcgtatctgcttgctcttttttagctgcttcagctgacgctaaagcgttcgcaatttggctttgacgtgtttcaatcgcattaataattggtggccaaacaaacttcatgcaaaaccacacgaaaagtgcgaatgcgataagttgaccaatcaatgttgcatttaaattcacaacgtcctccttactatgcttgttttacgttgataagcaaataaggtgattagtttaataaaccgatgaatgggtttgcgaaaatgaaaagtaatgaaataccaacagcaatcattgcaatcgcatctaaaagaccagctacgataaacattttagtttgtaagctagatgctaattctggttggcgagctgatgattctaagaatttaccacctagaatagcaaagccaattgcagtacctaatgcagcaaatgcaagaagaattgatgcaccgatgattgttgctgtaattacagtttccataattttctccaatagaagttaagttttagccctagagccggttaataaaaaacgattaatgatctgctttgttataagcaatacttaaataaacaaccgtcaacatcataaagatgaaagcctgcaaggtaataaccaaaatatggaaaatagcccaagcaagatgtaacggaatccctaatgctgcaatggccatattagcggaatacattacagcgataagaataaagatcaactcccctgcatacatgttaccgaataaacggaaggcaagtgaaattggtttagccaataaagtcaccgtttcaagaataaaattaacaggaataaacgcccaatgattgaatggatgaagcgtatattctttaactaaacctttgaatcctttagattttattgtataaaaaagaattaaaaagaaaacacaaatggacatacccaaagttgcgctaatatctgctgtcggcactgcacgaagataatgaataccgaacaaacctgcaaattgaggtaagaaatcaacaggaattaagtcgatagcattcatgatgaatacccaacagaaaattgttaatgcaagtggcgcaactacgttacgtggaccatgaaaattttctttcacgattccattaacccattccacaacaatttcaactaagcattgcatttttcctggaacgccagttgttgcttttttccctactcgagaaaaaacaaataggaaaataaccgcagcaagaatagaaaagaacaacgtatctatatgaacattccaaaatccatcccctgttttgagaaaggataaatggtggctaatgtattccgatgttgtttgtccagacataatcgatcctttgttctgaagaagaataacccaaagttaaattttattgagaataagtggaataatattattcagcactaatgccaataaaaaaccaacaaaaaacgcaataaaattgataacgaataaccatttgatggcaataatgataaaaaccatcgttaaaataaactttattgcttcagcacgataaagtgcggtcagttttgttgaaaaattttgttttctgtaaaaaatgataaatataaatgtacaaaaaggcaaaaaggcacttaaaaaaccgtagctaaaatctaccgcactttggcgttgccatccataaataagcaaataaaaaactacaagcaaaagactctcaataacaatagcttttctgtagttttttttagcgtgagataaaatgcgcgacatcacttttacaaaataattttagcccgccgattatacctttgctggctttagattcaacttaaaaacacataaaaagtgttatataaatcacacttttagaaaataatttatctatttgttactttttaacgtaaaacgattaaatgtcgttcgcctataagttcaggtacagataattcaatcactttttgaatagtatattttttattcaattcattaatttcatcttcctgataaatcccttttaatgcataaaaatatccattttcttttggtaaatgatggcaccaatctgtcatatcttttagtgaagcaaaagcacggcttaatacaccatcaaatttatcttcaggttgatattcttctactcgacttaaaacgggggttacattagttagtctaagctcacgtatagcatttcgaataaaactaatacgcttacctaagctatcaaggaggacgaattgtttggaaggattaataattgccaaaggtaaaccaggcaaaccaggccctgtaccgacatcaataaaacgatcaccttgtaaataaggacttacaacaagactatctaaaatatgtttaactaacatttcttgcggatcacgaactgacgtcaaattataagctttattccatttattgagtaaattgaccagattaatcaactgctgaatttgttgatcacttatttttatatttgcttgcgcaagtaaactgactaatttggctttcatatttattatctctttgaaaaattacgctattttacttaaaagtgcggtaaatttccttaatgtttttagtaatttgatgaattatttaccgaatcaatgtccagttttacaccataaattgaatgcacctccgcataattcatttcaaaggctttaattgcttctgttcaagaaccaaagaatgaatgttcgctaaaaaataagtttgttctgcttcaggaatggaaaatggcattaacttgagtaaatcttgatgaatagctaaaacttgtggaaaaatgaccgcactttgcatttcttcgagcatttctgaataaagcgaagaaacacaacctcctcgttctattcgacctaagctgcaagcaatgtgtagcagcataaaatccacttgaggcgtattcacatcagcttgccagtaatgagctaatcgatctcgtaaacgaaatatcacatcaataatagattgatttatttgcctgcgaattttccaacgttctagttgcttaaataaccgcatttgtttttgttagttcaaaatttgttcgctaatttaccgcactttactgaaataaaacagtgcatagatcacagttttgtagcaaaatggtaaaaaaatttgtaaggatgtaaaaatgttagattacgagatcttcaatccatatgaaggattgatttttgatatggatggaactttaattgatacaatgcccgtgcatgcacaagcttggacaatggtgggaaagaaatttggctatgaatttgattttcaaattatgtataacttcggcggggcgacggttcgaactatcgcgggggaaatgatgaaagcggcgaatatgccactagatcgaattgaggatgtgctggctgcaaaacgtgagttgtcttatcaacttattccgactcaatcaaagttattgccaacctttgaaattgttaaatccttccatcagaaaaagccgatcgctttaggttctggctcacaccgtaaaattattgatatgttgatggataaactggctatcgcaccttactttaatgcaattgtcagtgcagatgatgtaaaagaacataaaccacacccagaaacttttttacgttgtgcggagttaattcaagcaaatccaagtcgttgtatcgtatttgaagatgcggatttaggcgtgcaagcaggattaagtgcgggaatggatgtgtttgatgttcgcacacgagaaattatttcgccaagataatggatattttttcattttttagtgctgatttttggcaggctaatagcttatgctttatgtttatcagcgcgtttttgagtgcaacagtattaccaggtaattcagaagttatatttgttgcgcttgctgtacctaaattaatgttaggttctttatttaacgtagatatattagctctaatattgattgcaaccgctggaaatagcttaggaagtttaaccacttacggaattggacgatggatgccaaaattcgatcccaaaaattaccgcactttatgggcaataaatcagctacggcgttatggggcgattgctttacttttgagctggctgcctgtagttggcgatttattttgtgccatagctggttggttaagattaaattttgtaacgagcagtctctttatctttctgggaaaaatggttcgttatgttgcgttattgtttttgagtacaccattcttattataaaatgcgcaagaaaaagccccacaataaacgtggggcaaataacctaaggaaccaattttattaaaacaactgcaagttgcttacactataagactaatgctttataagaaagttcaaaattttttaaaaattttcaaaataaaaatttttgcataaaagaaaccccacaataaatgtggggcaataacctaaggaaccaattttattaaaacaactgcaagttgcttgttctataagacaatgaaccttactataaagttcattaaaatttgtaaaaaataaatatttattcaattatttcttaaccaactgatttataagggaaatttatgccattacttgatagttttaaagtggatcacacaaaaatgaacgcacctgcagtacgcattgcaaaaacgatgctcacgccaaaaggcgataatattactgtttttgatttacgtttttgtattccaaacaaagaaattctttccccaaaaggcattcatacacttgaacatttatttgctggatttatgcgcgatcatttaaatggcgatagcatagaaattattgatatttctccgatgggatgtcgcacgggattttatatgtctttgattggcacaccaaatgaacagaaagtgtctgaggcttggttagcttcaatgcaagatgttttaggtgtacaagatcaagcttctattcctgaattaaatatctatcaatgcggaagctatacggaacattccttagaagatgcacacgaaattgccaaaaatgttatcgcacgcggtataggtgtaaataaaaatgaagatttgtcactcgataattccttattaaaataggaagacgcttgattaacctaaaaaagttagtagtaaaaaacgcactttatgatctaccccaaaagttgactaaataaccaactaaggtgtagatttttttatgaccaaatacaacactcttttcaaacaacaagtcattgaattttatcttcaaaatggtaaaaatcgttcacttacccgcaggtattttcaacttgcctaaataacactaaaacgttggattaaccaattaatcatagttaaatcaatagattatccgtacttagtaagaaggcaaaattacttacctgaatttaaacttaacataatacaagcggttaaaaatgggcaattttctgcagaagccgcatatttacattttggcattaccaattcagacgttgttagtcaatggctgcaagcctttgaaaaacaaggtataaacggcttaatcctcaaatctaaaagtcgtccaatcatgaaaccgaaataccctaagatgccacctaaaccgaaaacatgaggggaagaactagaattggaaaatttactacgtgcggagaacgcaatcctaaaaaagttgcaagaactcaaccaacaaaaaaagacttgaagacgcaaaacccaattttacattccgaccaaggttggctgtatcaaatggtcggttatcaggcgattttacgagagaatagcattcaacagaatatgtcaaggaaaggaaattatttagataacaatgcgatggaaaacttctttggacgattaaaaactgaatgttattacgacaaacgatttgagacgttcaaacaactgaaaaaacaactcatgagtatattcattattacaaccatgatcacattcaggggaaactaaaagggctgaaccctgtgaatgacagaactcagtccttgaactaaatcaatctaactttttgggggaagataaatcccaacttgcggtcaattaatagcttgaattgattaacacttcttcgccatagccgcctaaagttggcattggttgataagtagagtttgcggcacgcattaaacgaataccacgaacacctgcttctttagctgctagtacatcatcatcgctgtcgccatagtgaatactcactttatgtgaaatgattgcaggcgttttgttatattttgttgtacgttcacggctgcccataaattcaactgggtgcatattcttaatattgaacgttttttctaaaattggtgttacaccatccactttgccagcagtacggccagtgaaaaagtaaacttggtcgccacgtgcttggtgcatattaattaaatctatggcaatttgtttaggaatagaatatttatcgcaacctgcatttacttcattccagaaatcttggtttttcaaataatcgtgtttacctggtgagaatttttgttgtccgtggtaaaagcaagggctactgaaaagcacggtatcatcaatatcaaaagcttacattaattggtgctttaccttctaaactttgtttgatttgatcaacactaatccaatgaattgcttgctcttgtaacatttcacgagcattagtgccagattgagtataaggttctgttttgcctgccatcgctggaactgcagctgcagttaaaagtgcgattacagataatttcatgacgtttttcattgcctttcctcacaaacgctgatttaaaaaccgctcagatcatacattttttagcttatattcaataattagcaatcgtttgccatctcaaaatatgatcaacttcacattttttatttatgagtgaagaataaatctacaatataaatttccctcttgaatttaatcaatttgtcgccatataacgaacaacttttcactttataaaggacagaacaatgacaacgattgtaagcgtacgtcgcaatgggcaagtcgtcgtaggcggtgatggacaagtttctttaggcaataccgtaatgaaaggtaatgctcgtaaagtacgccgtttatataatggcaaagtgcttgctggttttgcgggtggaacggcagatgcatttacactttttgaattatttgaacgtaaacttgaaatgcatcaagggcatttgctaaaaagtgcggtggaattagcgaaagattggcgtacagatcgcgcacttcgtaaattagaagcgatgctaattgttgcggatgaaaaagaaagtttaatcatcacgggtattggcgatgtggttcagcccgaagaagatcaaattttagcaatcggatcgggtggtaactatgcgttatctgcggcacgtgcgttagtggaaaatactgaactttctgcacatgaaattgttgaaaaatctttaagaattgctggtgatatttgcgtgttcacaaataccaatttcactattgaagaattaccgaattaaggaaaaagctatgtctgaaatgactcctcgcgaaatagtttctgaattagatcaacatattattggtcaagccgatgcaaaacgtgctgtggcgattgcgttgcgtaaccgttggcgtcgtatgcagcttcaagaacctttgcgtcatgaagtaactccaaaaaatattttaatgattggcccaactggtgtgggtaaaactgaaattgcgcgccgtttagcaaaattagctaacgcaccatttatcaaagtggaagcaacgaaatttactgaagtaggttacgtggggaaagaggtggattccattattcgtgatttaacggatagtgcgatgaaacttgttcgccaacaagaaattgcgaagaacagagcaagagctgaagacgtggctgaagagcgtattttggatgctttacttcctccagcaaaaaatcagtggggcgaagttgaaaaccatgatagtcacagcagtactcgccaagcgttccgtaaaaaattacgtgaaggtcaattagatgataaagaaatcgaaattgatgtgtctgctggcgtatctatgggggttgaaattatggctcctccaggcatggaagaaatgacaaatcaactgcaatcattgttccaaaatttgggttcagacaaaacgaaaaaacgcaaaatgaaaattaaagatgcgttgaaagcgttgattgatgatgaagcagcgaaattaattaaccctgaagaacttaaacaaaaagccattgatgctgtggaacaaaatggtatcgtctttatcgatgaaatcgacaaaatttgtaagaaaggtgaatacagtggtgctgatgtatcgcgtgaaggtgtgcaacgtgatttacttccgttagtagaaggctcgacagttagcaccaagcacggaatggttaaaactgatcatatcttatttattgcatctggtgcattccaagttgctcgcccttcagatttaattcctgaactacaagggcgtttgccgattcgtgttgaacttaccgcattaagtgcggcggattttgagcgtattttaacagagccacatgcttctttaaccgaacaatataaagcgttgatggcaacagaaggggtgaatattgcattcacaacagatgcagtgaagaaaattgctgaggcggcattccgagtgaatgaaaaaacggaaaatatcggtgcacgccgtttgcatacggtaatggagcgtttgatggataaaatttctttcagcgcaagcgacatgaatggtcaaacggtcaatattgatgcagcttatgttgcggatgcacttggcgaagtggttgaaaatgaagatttgagccgttttattctttaaagataaaaattttacatataaaagtgcggtaaatttttaccgcacttttttgttttcaggatagagaaactaattagtttttaatttgccccaatatttttcataaatatcaacagcttctcctacatcgccttgcataattcctttttctacttcttccgctggtgggaataattttggatcattagcaacttccgcgcttagcaatgttttcgccccattatttggcatagaaaagcccatgcgttcgataacaatttttgcattttcagggcgaagtaaaaagtcaatgaacttatgtgcaccttcaacattttttgctgtagtcggaatcgcatagttatccatccagaaaattgcaccttcttttggatacacaaattgaagagattgattttctttctgcgctaaataagctgaaccattccaaatcataccaattgcaacttcgccttgtacgtaagggacttcaggagaatcagagttaaaagtcgctacatttggtaacagtttttctaaacgctcataagctgttttgatgtcttcttcattggtggtatttggcgatttaccatccagtaataatgctacgtggaacacttcacgtgcatcactggtcatgagaactttgcctttaaattcaggtttccataaatccgcccagctagtgatggttttaggatcaatctcatccgcattaacttcaataccagttaagccgtaaacgtaaggtaatgaatatttattttctgggtcgaattctttatttaataaatgtttagggatttgatgaatattggtcaatttactttgatcaatcggttgaagcatcttttccttaatcattttatttacgtagtaacttgatggaaacaccaaatcatagccagaaccagtattctgagtaagtttaagtttcgcatacatttcttcgttgctttcaaaggtagaataaattacctcgatgccagtttctttagagaactgtgcgactaaatcagaaggcacatagtctgtccagttatagacgtaaagtttgttattggcaaaagcggaagccgcaaaaagtgcggtggtggaaaggaaaagatttttgagtgagtgagcaaagaattttttcaatttattgacctccgagggttatcgttcatcataaaacacgcaaattttgcgcgcgcgcagtatagcatttttttctaaaaggtttgacatatttccctttcggggtaagattttgccagttttttcctaagggattttttatgcttaattttgcctatcaagaacacgttcgctcttattatttcgactctcgtaaccaagattttcaattcccgccgctcactcaaattgaacatgctgatgtatgtgtgatcggggctggattttttggtttatctgcggcattagaactggcggagaaaggaaaaaaagtcattgtcttagagggtgcaagagtaggctttggtgcttctggtcgcagtggtgggcaggcaattaatggctttgaagaaggcattgatgaatacattaaacaagttggcgaagataaagcacataaactttggaatatgtcattagagaccattgatattattgatgaacgtattgaaaaatatagcattcaatgcgactggaaaaaaggctatgccacattagcattaaatgaacgccgaatggatgacttaattgaaatggaaaaagaaagtcataaaaattttggctatcagaatatgcaactttgggataaaactaaattaaaacagcacttaggcagtgatatttatgtgggggggctatttgatagtaattcagggcatttgcatccacttaattattgcttaggtttagcgaaagcttgtgtcgatctgggtgttcagatttttgaacaatctcctgtcgtggatatggttgagaaaaatggttgcgttgaggttaaaacagctaaaagtgcggttatttctcaagacgttattttagccaccaatgcttatattgatgtgctcccgaaatctattcatcacggcattaatcgtaaaatattacctgtggaaagttttattatcgccacagagccgttaagccaagcggttgctgattctgtcattaataatggcatgtcggtgtgtgataacaatttattattagactattatcgtttaagtgctgacaatcgcttgctttttggtagtgattcgagctcagaaaaagatatggtcgcgattatgcggaaaaatatgttgtgtgtattcccgcaacttgaaaatgtaaaaatcgattatggctgggctggcccgattgatatgaccttaaattcaacgccacattttggtcgtatttctccgcatatttattttgctcatggttattctggtcacggtgttgctttgactggtcttgcggggcgaattgtagcggaggcgattttgggtgacgatgaacgtttatctatttttgaaggactgaaagtcccttctgtttatggtggtcgaattatcaaagatcttgcgacaaagattggtgtgcagtattacaagtttttagataaataccgttaaaatacaacaatgtttttctaaagcattgccatcaaaattgactaaaataattaaattttgtatggatataaattctaaatcagttaaaaaatttaccgcactttaaagcaagaattaaaataatatttttcgctacaatttgtgttttccattaagagagaaatatgtcagaaaatttgttacttttcagcttgttagctgttgttattatattgattttattacttattctacgccaggcaaaaatatacacatcttcatcaagaattatcgaaaacgactcaagattataatcagcttgccagtaaatttgatgaacttagtagcattaaaaaccagtttgaacaacaaacaattaaagtacagactgaaaatcaaggactgcaatatcgtttaactgaacgtgatgaacaaatacatcatctcacgcaagaacgacaaaatttgactgaaaaattgaccgcactttctcaagaattaacggggttacaaacaaccttaacagagaaagaaaaatatttttctgcacaacaacagaactttgaacaatccaaacaacaattgggcgtggaatttcaaaacctagcaaatcgtattttggatgaaaaaagtcgatcatttagtcaatcaaatcaaacggcattggaaaccttgctcaagcctttccgtgagcaaattgaaggtttccaaaaacgcgtcaatgaaattcactccgaatccgtgaaaggcaatgcaggcttggaagcggaaattaaaaaagtgctggaaattggtctgaatatgtcgcaagaggcgagtaatttaacttctgcactgaaaggcgaaaagaaaacgttaggcaactggggcgaagtgcaattagaacgagcgttgcaactggcaggacttgaagaaaatgtacattaccgcgctcaagcgcattttaaagatgaacaaggtggacgaaattatcctgattttgtgttgaatttacctgatgaaaaacacttaattatcgacagcaaaatgtcgctcgtggcttacgaaagtgcggtgaattctgaggatgattttgaacgagagcgtttactaaaagaacatatttccgcattaaaaacccatattaacgatctgcataaaaaagattacagcaatctgattggcatgtgcagcccgaattttgttcttatgtttattgcggtggaacctgcgtatattgaggctttaaaagctgatcctgccttatttaattacggttatgaacgcaatgtaattatggtctctcacactacgctaatgccgattttacgcaccgtggcaaacctctggcgtatcgaacgtggtaatgctgaagccaaagaaattgctgaaaaagcgggcgaaatctataaccaaatttgcttggtggcagagcgtttaaacaaactcggcaatacgctttccactgtcagcaaccaatacaatagcaccgtcaccgcacttgttggccaacaagggttagttggcaaagtagaacgatttaaaaccctttccgcaaaagccaataaaacaatgcccgatgtggacttattgaataatcagctggatttggctagattgaatgtcttaaatcaagaaaatcttcaataatttattctccgattccgattgaatgtaaatttggtcggagaattttttatcctatctagaaattttgtgatcaatatcccaaatttgaaatttcttagttgtttttctatttttgttatctatatttgtcttatcgaaacgtttcgataacaaaaaggagcttttagatgaaaaaaacagctttattgaatgcgcaactttcgcattgcattgctacacttggtcatacggaaagtttgacgatttgcgatgcgggacttccaattccattaagtgtggaacgtatcgatctcgcattaactgcgggtgtaccaagttttctacaaacgttgaatgtagtaacgaatgaaatgtatgtngaacgcgttgttattgcagaagaaattaaagaaaaaaatccagaaatattgaccgcacttttaacacaacttcaaaaacttgaaagccatcagggtaatcaaatacaagtggaatttgtatcgcacgaaacttttaaaaaattcaccctcgaaagtaaagctattgttcgtactggcgaatgttcaccttatgccaatgtgattttatattctggcgtgccattttaatcagggtgaaattatggaaactttactcaaaattagtggtgttgataaatcatttccaggtgtgaaagccttgaataatgcctgtttatctgtttacgctggacgcgtaatggcattgatgggggaaaatggggcgggtaaatcgactttgatgaaggtgcttactggtatttattctaaagatgcaggcacaattgagtatcttaatcgatcagttaatttcaatggacctaaagcctcacaggaagctggcattagtattattcaccaagaactgaatttggtcggtaatctcacgattgcagaaaacatttttcttggtcgtgaatttaaaacctcgtggggagcgattaactggcagaaaatgcaccaagaagcagacaagttacttgcgcgtttgggggtaactcacagcagtaaacagctttgcgctgaactttctattggtgagcaacaaatggtggagatagccaaagccttaagttttgaatccaaagttatcattatggatgaaccaaccgatgcgctcacagatacggagaccgaagccctattcaatgtgattcgtgaactcaaagcagaaaatcgtggcattgtttatatctctcatcgtttaaaagaaattttccaaatttgtgatgatgtgacggttttacgcgatggtcaatttatcggtgaacgcgttatggcagagattacagaagatgatttaattgaaatgatggttggtcgtcgtcttgatgaacaatatccgcatttatcacaagaaaaaggcgaatgtgtattggatgtgaaacatgtgagcggaagcggcattgatgatgtttccttcaaattgcatgccggtgaaattgttggtgtctcgggcttaatgggcgcgggtagaacggaactcggcaagctactttacggtgctttgccaaaaacggcgggaaaagtgcggttaaaaaatcaagagattgagaatcgcagtccgcaagatggtttggataatggtattgtatatatttctgaagatcgtaaaggtgatggcttggttttaggaatgtcagtaaaagaaaatatgtcgctcacatcgctcgatcatttttcacaaaaaggcggtattcgtcatcaagcggaaaaaatggcagtagatgactttattctgatgtttaacattaaaacacctaatcgtgatcaacaagtaggtttgctatctggtggaaatcaacaaaaagtggcaattgctcgtggattaatgactcgcccaaatgtgttaattttagatgaaccaactcgtggcgtagatgttggcgcgaagaaagaaatttatcagttgattaacgaatttaagaaagagggcttgagtattttaatgatctcatctgatatgccagaagtgcttggtatgagcgatcgagtgttggtaatgcgtgaaggtaaaattagtgcagaattttctcgtgaagaggcaacacaagaaaagttattagcagcagctattggtaaataagagtaggtaagtatgatgaaaaatgaaacatctaattttcaaataggaagatttttgattgaacagcgttcttttattgcattgattattcttatcgcgattgtatcaatgattaatcctgatttttttagcgtagataatattttgaatattttacgccaaacttcggttaatgcgattattgcagtgggtatgactttcgttattttaattgcaggtatagatctttctgttggatctgtattggcattgacaggtgcaatcgccgcttcaatggtgagtattgaattgcctatttttttagtcattcctgtggttttattgattggaacacttcttggtggcataagtggtgtaattgtggcaaagggaaaagttcaggcttttattgctaccttggttaccatgaccttactgcgtggtataacaatggtttatacagatggtcgtcctattacgacaggtttttcggataatgctgatctatttgctagcattggtacaggctatgttttaggtatcccagtaccaatttggattatgagtatcgtgtttgcggttgcttggtatattttaaaagacacaccaatcggtcgctatatttatgctttaggtggaaatgaggcagcgacccaactttctggtattaacgtcaataaaatcaaagtatttgtttttgcggtgagtggatttctttctgcgctggcgggtttaattgtaacttcacgtttatcttccgctcaacccactgctggcgtatcttatgaattagatgcaattgccgccgtggtagtcggtggaaccagtttgatgggggggaaaggtcgtgtaatgggaactctcatcggtgcattaatcatcggatttttaaacaatgcattaaatttattagatatttcatcttactatcaaatgatagcaaaagcgttggttattttggttgctgttttagccgataactatcttggtacaaaaaaactgtaactcactttaaggagaaactatgaaaaaactaaccgcacttacttctgctgtattattaggtttggctgtttctagctctgcttctgcgcaagacacaatcgctttggcagtatctacattagataacccattttttgtaacgttaaaagatggcgcacagaaaaaagcggatgaattaggttataagttagtagtgcttgattcacaaaatgaccctgctaaagaattagctaatatcgaagatttaactgtgcgtggtgcaaaaatattattgatcaatccaactgcttctgaagctgttggcaacgcagtggcgattgcaaaccgtaagcatattccagtaattacattagatcgtggtgcagctaaaggaaacgtagtgagccatattgcatctgacaatatcgcaggtggtaaaatggcaggtgattttatcgcacagaaattaggcgataatgccaaggtgattcaacttgaaggtattgcaggaacatctgcggcacgcgaacgaggtgagggtttcaaacaagctattgatgctcataaattcaatgtgcttgccagtcagccagcagattttgatcgaacaaaaggtttgaatgtaacggaaaatttgttggcatctaaaggtgatgttcaagcaatttttgcgcaaaatgatgaaatggcattaggtgcattacgtgcggtgaaagccgcaaataaaaaagtccttatcgtaggttttgatggtaccgatgatggtgttaaagcggtaaaaagtggcaaaatggcggcaactatcgcacaacaacccgagcttattggttcattaggtgttgttaccgctgataaaatcttaaagggcgaaaaagttgaagcgaaaattccagtagatttgaaagtaataagtgaataatctatctactaaataagctcgttatatcacattatggggcaaattatatttgtcccattgtgtagaaagaaaaaatataacaatacaggataaaataatgagaaaaaccctcacggttctcggtagtatcaatgctgatcacgttatttctgtgccttactttactaaacccggtgaaacgctaacaggtcaaaattatcaaattgcctatggtggcaaaggtgccaatcaagcagtggcagccgctcgtttaggggcaaaggtagcgttcattagttgcattggatcagatagcataggcaaaacaatgaaaaatgcgtttgcacaagaaggaattgatacaacccatattaataccgtttcacaggaaatgacaggaatggcatttattcaagtcgccaagtctagtgagaacagtattgtgttggctagcggtgcaaattcacatttgagtgagatggttgttcgtcaaagtgaggcgcaaattgcacaatcagattgcttgttaatgcaattagaaaccccactttctggtgtggagctggctgctcaaatcgctaagaaaaatggtgtcaaggttgtgctaaatcctgctccagcgcagattttatcggacgaattattgagtttgattgatattattacaccaaatgaaactgaagctgaaatcctgactggggtagaggtagccgacgagcaaagtgcggtgaaagctgcgagtgtttttcacgataaaggcattgaaaccgtaatgattacccttggcgcgaaaggtgtgtttgtcagtcgaaaaggtaaaagccgtatcattaagggcttttgtgtgcaagcaatagatactaccgcagctggtgatacatttaatggcggttttgttacggctttattggaagaaaaatcctttgatgaagccattcgttttggtcaagctgccgctgcgattagtgtgacgaaaaaaggggctcaatcctctattccaacgcggcaagaaactttggaatttcttgaacacgcttaaagtgcggtgaatttttagggtgtttttatggcgacaatgaaagatattgcacgactggcgcaagtttcgacttccacagtttcacatgtcattaatggatcgcgttttgttagcgatgaaattcgtgagaaagtgatgcgtattgtcgctgaactgaattacaccccctcagctgttgcacgaagccttaaggtgcgcgaaaccaaaactatcggactacttgtcaccgcaacaaataatcccttctttgcggaagtgatggctggcgtggagcaatattgtcagaaaaatcaatataatcttattattgctacaacgggtggagatgccaaacgcctacaacaaaatctgcaaactctaatgcacaaacaagtggatggtttgcttttgatgtgtggtgatagccgttttcaggctgatatagagttagccatttcgctgccactggttgtgatggactggtggtttactgagttaaatgcagataaaatactcgaaaattcagcacttggtggctatttggcgacaaaagcattaattgatgcaggacatcgtaaaattggcattattacgggaaatctcaaaaaatctgtcgcacaaaatcgtttgcaaggttataaaaatgcgctctcggaagcaaaaattgcgttaaatcctcattggattgtcgaaagtcattttgactttgaaggcggtgtacttggcatacaatctttacttactcaatcttcacgtccaacagcagttttttgttgtagtgacaccattgctgtcggtgcataccaagctattcagcaacaaggcttacgtattccgcaagatctttcaattatgggttatgatgacattgaattggctcgttatctctcacctcctctctccaccatttgccaaccgaaagctgaacttggcaaactcgctgttgaaacactattgcaacgaattaaaaatcctaatgaaaattaccgcactttggtgttagaaccgacttgtgtgttaagagagtctatttacagtttaaaataaaattagaataactcgatttctctattgctattttcaaaaaaactgctattttcttgcggtttttttgtttatttaacccactgtttaatttaggaataaaatcttatgaaagaaaacaaacctgttgatccttatgcgaaatataacgaacaatcgaatattatcgcgaaaataatttttgctagtcgctggttgcaagtgccgatttatttgggcttgattgtcacccttgcaatctactcttataaatttatcaaaggattatgggagttagtgattaatgtaaatgatatggattccaacacaattatgttaggcgtgttgaatttgattgatgtcgtgatgatcgcaaacttgcttgtgatggtgactatcggtggctatgaaatctttgtatctaaattgcgtacgcgtaatcatcctgatcaacctgaatggatgagccacgtaaatgccaccgtgttgaaagttaaactttctatgtctattatcggcatttcatctatccatatgttgcaaacttttgtgaatgcaagcaatatgccagaaaaaacgatgatgtggcagttattgttgcatttgggctttttagtgtcggcaattgctttagcttatacggacaaaattttgtatagcacaagccataaaacgcattaaaaatttaccgcacttttaaccccgttcaaattgaacggggttttatatatcatatagttacaatttaattttttagtatgatacgccgtttagaataggaaagcttaaataaaatactaagatgttaatcaagtagaaattaatcttctaaatctagaggctcttgcgaaagtataattcctgtcagatctgcgtaaatataatcttctgggaaaaaggttacgccaccaaaattcactggaatatcactctcgccagcactgctttcatctgcactaactggaattggcgcaagggcatgaataccaatatcgaggttttctaattgctgaatttggcgtactgcaccatatacaataatgccttcccaaccattatcaacggcaagttgagccaattctgcatcaatcaaaccacggcgtaccgcaccaccgccatcaatgacaagcactcgaccttcgccgttttcttctaatacttcagcaattaatccattactttcaaagcattttactgtagtgactttaccgtaaaawttacttacgccaccaaagcttgaaaaaattggctccacgacatccacttgttctgcataaagatcgcaaagttctgaagtatcaataaacataactttcccctatcgattgttgaaattttgtttgctttagtatatgccgatttagccgataagcaagcctaaactaaacaagatattgattaataacgaaattcatagacatttgagccaatattggacgcaattcacttggctgctgactgcaataaacaaagatcgcatgtttagctaacaacggcattgctaatacaaataaataatttgtccaagaaatagccgttgccaccgcaaatgctaaataacatagggccgccacacttaataaaatacaatgataaacacgccctttatatgcacctaaacgaacggctagggtatttttgccagctttcgcatcctgttcaatatcgcgtaaattattgatatttaataccgcacttgccaataagccagaaccaatagcaggcaaaataatgtggctatcaatactgtgagtttgcaaataataagtaccgccaacaccaagcaaaccaaaaaataccaatacagaaatatcgcccaagcccatatagccataaggttttaccccaactgtgtaagtaatggcagcaacaatagctaaaattccaagcccagcgaaagcgaataaatctgagagattttcataagcgattccaatcaagaaacttcctgaaagaaaacttgccatcaccattaggattaatccccatttcagttcttttgctgaaattgcgcctttttgaatgccacgtaatggcccaatacgttcttcagtatctgaacctttttgatgatccccataatcattggcaaaattagaaagcacctgcaataaaattgtcgtgagtaaacaaagcaccattacaagcccattaaaaccttgtggattcgcccaataacctaatgccgaacccgtgaaaatcgatgccaacgctaatggcaaagtttttggtcgagccgtttcccaccacattttcaatttttcatttatcattttttttgaccgcacttttgattacaataagccgcgtattctacactaagacacccaatttatgaatgatttaaccttatcgcctatcgccattatccacacaccttataaagaaaaattctccgtaccacgccaacctaatttagttgaagacggtgtaggcattgtagaactcttaccgccttataattcgcctgaagccgtgagaggattggaacaattcagtcatctttggttaatttttcagttcgaccaaatccaacaaggaaaatggcaacccaccgtacgcccacctcggttaggcggtaatcaacgagttggtgtatttgcttcacgcgcaacgcaccgcccaaatcctcttggtttatccaaagtcgaattacgtcaagtagaatgcatcaacggtaacatttttctccatttaggtgcggtggatttagtggatggcacgcccattttcgatatcaaaccctatattgcctatgcggatagtgagccaaatgcgcaatcgagctttgcccaagaaaaactaccagtaaaactgactgttgaatttaccgagcaagccaaaagtgcggtaaaaaaacgagaagaaaaacgaccgcacttaagtcgttttattcgccaagtgctagagcaagatcctcgcccagcctatcaacaaggtaaaccgagtgatcgtatttatggtatgagtttgtatgaatttaatgtgaaatggcgaattaaagcgggtacggtaaattgtgtagaagtgattgaaatagaaaaagacaaatagatgtaatatgtaaataaggcaggtaatccctgccttagttaatttaaatgccttattttaggaaaaactgccctttagttaatttatatattgtcattaaaaccaataagccaatcattacatttgagaaaacaaaggcaaaaatagacacgccttgtaaaacattgccatgatagaaagcggtagcactgtttgccatagacgctaatccgaatgagaatgcccataagccaatgttaagtcctttttccacaatccaagggaataatcgcaataagaaaaataattgcaaaaatccatatccccaaaggattttagctaacgtatccacctcgccgtgattgatcgataaataagcagatacacacacaaacgcaggtgctaaaacaatccccatggtggctctaaattgtggctcaagagatgaaatacgtaaatgttgtaataatacaggttcaaaaataatccaagcaatcattcctgcgccaaagaataagtagcctaaatcatgatagccaagtaatgctaatgracttgcacttgtgaaatttgcagcaaccgcaggcaaataaaacgaaggatgagtagatttttgctcaaatacaccaccttgccataattcactgacacgtaatgttgagaaaagtaattgaccaatcgttccaatccaaattaaaacttcagcaattaaaggattccaacgataaagaatatcgcctaccaacatagttgtaataggaatcaatgcaataaaggaaaaacgaactgggctatgatactctgcacgaacttcctcaaagtaataacgaagtttatacgcatacattaaaataaataaaatccagaccgcacttgctacaatgccaagracatcacttaccattcgcgcagcaggaaataagttttctaaatgaaaccaagctaaagataaggctgctaaaccaagaggaataccgaaatatcctgttggaagaggaaaaggctttgttatattcatagtatganccttattttgaaaaatatgagcaaagtgtaacataactatcaacaacagacttttctaaaagtctcaaatttttgtgaatttctatgaagaaacatacttgttgntctggcataaaacctctacccattttcataaaaataaaaaaaccgnactttcattcgggttttcttatatagggaattaattattccgcatcatctgccatgttaagcatttcagctaagcttataatatcttttgaacttgaaactaaagtatatatttcttaaatggcttaacaaacttatctatcatagatatggctctttgctctgcttgagtaacaaaatgttttagataagattttgcccattcttctctagttccattaaacccctgatctaaatctcttacatgaaactgaatttgcatagctgcagcccagttaatatatagttcactaggttcagatttaaatagttcagcaaaagaagtagatacacaaactagatcttcaccattaagttcccagtctacttctaaataattaatatcaaataaatcaaattctttattatcaatcatttttgcacacgtctgagctaatttatatgctgaaataatattgggtgcttgagctgatttactaatatttcttgttttgacatctaacaattcatagaactgatcctttactaataaaatatctgcagtatcattttgtttctcctcaaataaatttnctatgctccaattttcagttgcagctttacctctacttaacaaaaaaagcaatgttggagaattaaataatttatatctagcttcatgtccaattatcgcaggcttcttcataaataaatcattaagatattcatattgcttaaatgttaaatctgacaggttttctttcaaaaacttatatactaatttttcaaatggttcccctgcagcatgacctgacagagtacctgatttaggacgtttcactttttgcccgattaatattgaattaatatcctgataaataggttttatgaaactcatatttccacctttatacctaatttttctaaatttaagttaatctcatgtaaaattgaaaattctttgtttgataaatattttcttactaaattagttatatcatcatgaatttttttttcgctttttaattgccaatctattcttctaaaaggaatatttgctaatggtttttctgaaaattcaactacattacctttgacaacacccttatacttcatccataaaaacacagctttagagtttaaatatgctgtaatatactcaatactctcctttacattttctttcttatataatgcagtaacatcctgtgttggatatataaattcatcaactaagctaaatctaaaattacttttttttgaaattctttctttgcacggcacaaatattttcttctcattcttgctgaatagagaaaaatttctaagaaaagcccacttccaataaggcaaatatttattataactatatctttttaatagataatctttataattattaaactcataaaagaaatttggaaaataagtgattaatttatcctcattaatatcatctaatatgaacttgtatctggtgtatccagagaaacaaaatgcgtctaagtgtttagctttagctacacaaattgaattaagcaattctaattctgaataatttatatcattcatctgaaaagccttatctagaccacttaccatcccattcccaatatcacagacacttccgattctagaaaactcaagatcatcaaataatgattttggctgaacttttttgatagttttgcagtaactctcaaatttatctaatgcaactttaatatgattgggcgaagtaacccaaacatctgagctagaaaatcttggaatataatatgattcacctaaagattctatatcctcagattttattgggctttttgaatctatattaataatattnatattatcaatatttttnccttttatatatttaaaaataacaactgaagangaaactccatgaaatactttactttcattaaataatataattttttcaaaacttccattatttatcaaaaatttccttaaaccctcagcgttcttagtggaaaaaaaataatcagggcaaataaatattaattctcctccaacttttaattgaagtatagatttaataataaaaatatagaaataatcacaaagactattacaatacattttccatatagaattatctttaagctctttcttctgaagctcacttaggtttttccaacgaacataaggaggatttccaatgatcgaatcatattgaggcttatcatatgatgttataaaacttgagttaattacaaatggatgagaaataatatcaccatctatttcatacgatgttaaatttgtataacctaattgaattaaactatctagaaatacaccattcccactactaggttctaaaatactagcatttttatttttcgtcattagtccaatcatatatttaacaatatgtgtaggagtaaaaaactgacctagtgatattttctttgattcatccatatttttatcctatttttctaataaaarccctcagaactctcattctgagggtttaaacataagatacaaatattaatcttctatttcagaatttaacaatgttgcaagattttgcgttgcatcatctgccgttatgacaaactcatcagcgatagcggcttcatcttcttcagataatttcgctacgacatcatcaactaagcgatgtttatgacgattttgatgatacgcaaaacctgtacccgcaggaattaatcgacctactattacgttctctttcaagccacgtaattcatcacgtttacctgccactgctgcttcggtaagaacacgagtagtttcttggaacgatgcggcagagatgaaggattcagtcgcaagagacgctttggtgatacccaataattcacgttcaaattcaactggtggtttaccttctgcttcacgttggcgattaacaattttcacgcgagccacttcgacttgttctccctcaaggaattctgagtcgtaagctttagtaattaccgctttacgtaacatttggcgaacaattacttcgatatgtttatcgttgatttttaccccttgtaagcggtaaacatcttgcacttcgttcacgatgtattcagttactgcacgcacgccacgtaaacgtaaaatgtcgtgtggtgtttcagcaccatcagaaattacatcgccacgttgtaccatttcgccttcaaatacgttgagctgacgccattttggaatcatttcttcgtaagtttcgccttccgcaggagtaattaataaacggcgtttacctttggtttctttaccgaaagacacgataccagaaatttcagccaagatagcgggttcttttggtttacgtgcttcaaataaatccgcaacgcgtggtagaccaccagtaatatctttagtacccacggattcttgcggaatacgtgctaatggttcacccacttttactgctgtgccatcgtctaaacttacgattgctttaccaggtaagaagtattgtgcaagaacatcagtttcaggtaagaaaatatcgttgccatttgcatcaactaatttaatagttggacgtaaatctttacccgcagttgcacgttcacccacatcttgaaccacgattgatgataaacctgttaattcatctgtttgacgcgtcacagttaaaccatcaataatatctacaaatttcacaaaaccagatacttcagagacaactggcattgtatgtggatcccaatttgcgatagtttcgcctgcagtgacttcttgaccgtcacctttgcttaataccgcaccataaggcactttataatgttctttagtacgaccaaatgcatcagtaatagttaattccgtgttacgagaagttaatactagtttgctttcatcgttagtcacgaattttgcattcattaaatgcactgtaccagtgtttttaacttgcacactagattctttcgctgccgcagatgccgcaccaccaatatggaacgtacgcattgttagctgtgtacccggctcaccgatagattgagcggcaataacgcccaccgcttcgccttggttgattaaatgaccacgagcaagatcacgtccataacatttcgcacatacaccaaaatcagtatcacaagttacaacagaacgtacttttacgctatctacagagtttgcatccaacacatcacagagtttttcatctaataaggtgttacgcggaattaatacttcttctgtacctggttttaaaatatcttctgcagcaacacgacctaatactaattcacgaagtggcactttttcatctccaccttcaattaatggggtcatgactaagccttcgtgcgtaccacagtcatcttctacaatcactaagtcttgtgccacatcaactaaacgacgagttaagtaacctgagttcgctgtttttaatgcggtatccgccaaacctttacgagcaccgtgggttgaaataaagtactgtaatacgttcaaaccttcacggaagtttgctgtaattggggtttcaatgatcgagccatctggacgagccatcaaaccacgcatacctgctaactgacgaatctgagctgcagaaccacgcgcaccagaatcagccatcataaagatactgttaaaggacgcttgtttttcaggattaccttcacgattgatgacttcttcttgagataagttttccatcatcgctttcgctacgcgctcattcgcggcagcccaaatatcgattactttattatagcgttcgcctgccgtcacaagacctgattggaattgttcttggatctcagctacttcttcttccgctgcagaaataatttcgtatttcttcgctggaatttccatatcatcaataccaactgatgaaccagaacgtgccgcatacgcaaaaccggtatacataatttggtcagcaaacattaccgcttcttttaaacctaaacgacgatatgcttcgttaatcagtttagaaatagcttttttacctaatgtttggttgaacaatgaataaggcatgcctttcggcgcgatcatccataagattgcacgaccgatagttgtatcagtcagcgtggttttcgcatcaaattcgcccgcttcatttttcacatattcagtaatacgcactttcacgcgagaatgtaattccgcttcgcctgtacgatatgctttttcagcttcgcgaggatcttgcaataacataccttcgcctttaccgttcactttttcgcgggtcatatagtaaagacctaataccacgtcttgtgatggaacgataatcggatcaccgtttgctggagaaagcacgttattggtggacatcatcaacgcacgagcttctaattgcgcttcaagggttaatggaacgtgtaccgccatttggtcaccatcgaagtctgcgttgaacgccgcacaaacgagcgggtgtaattgaatagctttaccttcgattaagatcggttcaaacgcttggatacccaaacggtgaagtgttggcgcacggttcaatagaattgggtgttcacgaataacttctgcaagaatatcccaaacgatcgcatcttcacgctcaaccattttcttagccgctttgattgtcgtagcataaccacggctttctaatttcgcatagataaacggacggaataattccaatgccattttcttcggtaaaccacattggtgtaagtgcaagtatgggccaacagtgattacagaacgaccagagtaatcaacacgtttacctaataagttttgacggaaacgaccttgtttacctttgatcatatccgctaatgattttaatggacgacggttagaacccgtaattgcacgaccgcggcgaccattatctaataaggcatcaacagattcttgtaacatacgtttttcgttgcgcacaataatatctggcgcaattaaatctaataaacgttttaaacgattgttacggttgattacacgacgatataaatcgttcagatctgaagtcgcaaaacgaccgccatcaagtggtactaatgggcgtaaatctggtggaagaactggcaataccgtcatcaccatccattctggtttattaccagattgaacaaatgcttctaataattttaagcgtttagtgatttttttacgtttagtttcagagttagtttcttgtaattcttcacgtaatttttcacattcagcttcaagatccataccttttaagagatcttgaatcgcttcggcacccattttcgcttcaaattcatcttgccagcgatcttcagcgtcaaggtattgttcttctgttaataattgaccgcgctctaagtccgtcatacctggttcggtcacgatgtacatttcaaaataaagtacacgttcgatgtcgcgcaatggcatatctaaaagtaaaccgatacgagacggcaatgattttaagaaccaaatatgtgcaactggcgatgcaagttcaatatgacccatacgttcacgacgaactttagtttgagtgacttcaacaccacatttttcacaaatcacaccacggtgttttaaacgtttatatttaccacataaacattcgtaatcttttacaggcccgaagatacgcgcacagaaaagaccatcacgttcaggtttgaacgtacggtagttaatggtttcaggtttcttcacttcaccaaatgaccaagaacggatcatatctggggaagctaacccaattttaatcacatcaaaatcttcactggtttttgattgtgcttttaaaaacttaactaagtctttcacaaatgttctcctgtcggagttaaaggtttaaagtgcggttaaaaatttcggagaattttgaccgcacttcggcgatttcaaatcttatgttgttgttcctcttgccttcccctgctttgcgagggaaggtgcccgaagggcggaagggggcttaggatataaatcccccctcagtcttcgcgccagctcccccgtaaacgggtggagccaagggatcagcaccatttatagtaatcagtgattactcttcgtctaactcgatatttaaaccaagtgagcggatttctttcataattacgttgaaagattccggtgtgcctggctccatatgttggttgccacttacgatatttttatacatcttcgtacgaccattcacatcatcggatttcacagttagcatttcttgtaaggtgtaggctgcaccatatgcttcaagtgcccatacctccatctcaccgaaacgctgaccaccaaattgtgccttaccacccaatggctgttgtgtaacaaggctataagaacctgttgaacgagcgtgcattttatcatcaactaagtggttcaattttagcatgtacatataacccacggttactggacgttcaaatttctcgccagtacgaccatcgtaaagggttatttgacctgaagttggtaatccacccagttttaatagctctttgatttccgcttcgtctgcaccatcgaacactggcgttgcaactggtaagcctttacgtaaatttcccgctaaacgcaatacttcttcatcagtaaaggtgcttaaatccactttttgtgaaccattacctaataaatcgtatgctttttggatatagctacgtaatttttccacttcttgtttttgtttaagcattgcattgatttgatcaccaataccttttgccgctaaacctaagtgagtttcaaggatctgaccgatgttcatacgagacggtacgcccagtgggtttaatacgatttcaactggctgaccattttcatcgtatggcatatcttcaactgggttaattttcgagataacacctttgttaccgtgacgacccgccattttatcccccggctggatttgacgtttcactgcaaggtaaactttcacaacttttaatacgcccggtgcaagatcatcgcctttaatgattttcttacgtttcacttcaagtttatgttcaaactctttacgaagttcttcgtattgctcagcaagctgttctaattggttttgtttttcttcatctgcaatggtttgttctaaccatttagtgcgatctaatttatctaattgcgccgcatccgcaccactagaaataagaagattacgcacacgagcaaataaaccagcttctaaaatctctaactcttcagttaaatcttttttcgcttcacgaagttgcatttcttcgatttctaatgcacgtttatctttttctacgccgtcacgagtgaagacttgaacatcaataaccgtacctgatgtaccatttggcacgcgtaatgaagaatctttcacatcggaagctttttccccaaagattgcacgtaacaatttttcttctggggttaattgagtttcgcctttaggggttactttacctactaagatgtcgccacctttaacctcagcgccgacataaacgataccagattcatcaagtttgcttaacgctgattcacctacgtttggaatatccgcagtaatttcttctgcacctaacttagtatcacgcgcaacacaagataattcttgaatatggatggtagtgaaacggtcttgttgaacaacacgttcagaaactaacattgagtcttcaaagttatagccgttccaaggcatgaacgctacgcgaatattttgacctaatgcaagttcccctaaatcagttgaaggaccatctgctaatacttcgccacgattaattggatcgcctaaattcacacaaggaatttggttaatacaagtattttggttagagcgggtgtatttaattaaattataaatatcaataccagcttcacctgcaatggtttcatcttcatttactttaatcacaatacgagacgcatcaacgtactgaacggtaccaccacgttttgcaacaaccgcaacacctgagtcaagtgcgattggtttttccatacctgtaccaactaatggtttatccgcacgtaatgttggaactgcttgacgttgcatgttcgcacccatcaacgcacggttcgcatcgtcatgctcaaggaatggaattaatgcagccgcaacagataccacttgttgtgtcgaaacatccatatagtgaatatcttcaggtttatataaaccagattcaccacgttcaccacgagcagtaacgaaagcatcagtaaaacggttattttcgtctaagtttgagtttgcctgtgcaatgatgtagtttgcttcatcaattacagataagtattcaatttcttcagtaacttgaccatcaaccactttacgatatggtgtttctaagaaaccataatcattagtacgtgcaaaagcagaaagtgagttgatcaaaccgatgtttggaccttcaggggtttcaatcggacataaacgaccatagtgagtattatgtacgtcacgcacttcaaagcctgcacgctcacgcgttaaaccgcctggacctaatgcagaaatacgacgtttgtgtgtcacttctgacaatgggttgttttgatccataaattgcgaaagctgtgaagaaccaaagaattcttttactgccgcagaaatcggtttcgggttaattaagtcttgtggcgtgatcgcatctaaatcgcctaaagatagacgttctttgaccgctctttcaacacgcactaaaccgatacggaattggttttcagccatttcgcccacgctacggatacgacggttacccaaatggtcaatatcgtctacttcgccacgaccattacggatgtcgatcaatttacgcattaccgcaataatatcttcattgcttaaaatacccgcaccttccccttctggaaaagctaaagaacggttgaacttcatacgacctactgtagataaatcataacgttctgcagagaagaataaattattgaataacgcttctgaagattctggtgttggtggctcgcccggacgcatcatacgataaatttcgtaaagcgcactagttttgtcataagttggatcgacacgtagcgtttcagaaatatatggaccgtaatctaaatcattagtaaataaagtttcgatcgtggtgtaaccagcttgtgctaattttgcgagggtttctaacgaaatttcgccatttgcaggacaaataatttcgccagactctaaatcaacataatctttcgacgcaactttacctaaaatatattcagaaggcacaaccacttgtgagatattatctttttctaatgctttaatgtgacgagcagtgatgcgacgaccacgttcaacatacactttgccatttgcttcaatatcaaaagaagccgtttcaccacgtaaacgttctggcactaaagtcattaacaatttatcgccagcgatttcaaaggtaattttatcaaagaataagtttaagatttcttcagtggtgtagcctaatgcacgaagaatgattgttgccggtaatttacggcgacggtcaatgcgcgcaaataagttatcttttggatcgaattcaaaatctaaccaagaaccacggtaaggaataatgcgtgcgttataaagcactttacctgaagaatgggttttacctttgtcagaatcaaagaatacacctggactacggtgtaattgtgaaacgataacacgctcggtaccattaattacaaaagtaccgttatcagtcattaatgggatttcccccatataaacttcattttctttaatatctttaactgcgcgtgaagaagattctttatcgtagctcactaaacgtaattttacacgtaagcctgctgcataagttgagccacgaatttggcactcacgtacatcaaactctggctcttctaaacgataatctacatattgtaattctgtatagccattattgcttacaataggaaatacagaacggaatgccgcttctaaaccttgctgaccttcaggatctttttgaataaatttatcaaaagaatccaactgaatggttaataaataaggaacatttaaaacttgcggacgtttaccgaaatctttacgaattcgttttttttcagaataggagtaacccattggttttcctctgctaactgttcagtgacctagccacaaactaactgtgacgtgaatgaccgttaaaatgaccgcactctgaaccttacttctatagtggggtgacaactcaaattacatagaacgacaacttgagcaaaacaacgacaaataacggtgaatttgtcattgtgtggatgtgctttctatcaaaaacacggttaaattaagcaataaaaggtcaagattgattaaaaatcaatctaaatctttgctaattttaaggcggtaaattttaaatgaatgcagctttctcgtcaagtttaaaacttatatagaaattttatgaaacaaaaaaaccgcactttcaaaaagtgcggtttaaaatctatcaattctttaaattataaagaagcttgatcaacagcaacacctgcacccatagtggtagagatgcttactttcttgatgaaaatacctttagcagtagttggttttgctttatttaaagcagccaataatgcttgaagattttcttttaattgaacttcagagaagtttgctttaccgatagtggtgtggatgataccgtttttatcattacgataacggatctgaccagatttagcatttttaactgcttcagcaacgtttggtgttacagtaccaactttagggtttggcattaaaccacgtgggcctaatacttgacctaattgaccaacaacacgcattgcatcaggagaagcgataacaacatcaaagttcatttcgccttttttgatttgctctgctaaatcttccatacctactaaatcagcaccagcttctttagctgcatctgcgttagcaccttgagtgaacacagctacacgtacttcacgaccagtaccgtgtggtaatacagttgcaccacgaacgttttggtcagatttacgaggatcgatacctaagtttactgcaacatcaacactttcaacgaatttagccgttgcgaattgttttaataccgcaatcgcttcgttaatttcgtatgctttagtagaatctacgccagctttgattgctttcatttttttagtcaatttagccatcgtattattcctccaccactaagcccattgaacgagcagtaccagcgattgatttcattttcgtttcgatagtcgcaccagtcatatctgctgctttagtttcagcgatttgacgaacttgatctaaagttactttacccactttatctttgttcggtttaccagaaccagatttgatacctgcagcttttttcaataatactgctgctggtggagttttagtgacgaaagtaaatgaacggtctgcatatacagtgataacaactggaattggtaaacctttttctaagctctcagtacgagcgttgaatgctttacagaattccataatgttcacaccttgctgacctaatgcaggaccaactggtggtgatgggttagccataccagctgcaacttgcaacttaacataggcttggactttttttgccattttagttttcctctaattgggtaataacgctattaaatagctccccgataatttttagtgcaagattcattgcaccacacaaaaatatgagccacaaacggctcataatgggcacggattatataaaaagtgcggttgtttttcaagcacttcttaaatccgatagaagatattatagtgcatcaccaattaatactgaatctaacgcaatttcaatcatatcattgaatgttaattgacgttcttctgccgtggtttgttcgtgagtacgaatatggtcagacacggtacaaatcgttaatgcttttgcaccatattctgcagccacaccataaattccagcagcttccatttccacacctaaaatgccgtatttttccattacatcgaacatttccacatcgggtgtatagaataaatccgccgagaataaattacctacacgaacgactttaccttttgcttttgcagcttgaacagcggcttgtgccatatcaaagtcagcaatagctgnaaagtcgttatctttgaaacgaatacggtttacttttgaatcagtacatgcacctaaaccgataatcacatcgcgcactttcacgtccatacgaacagtgccacaagaacctacacggataatttttttcacgccatattcagtgattaattctttcgcgtaaatagagcaagatggaatccccataccgtgccccataatagaaattttacgacctttataagttccagtaaaaccaagcatattacgaacattcgttacttcaacaacatcttgtaaaaaagtttctgcaatatattttgcacgaagtggatcgccaggcattaaaacaacatcagcaaatgcaccttcaggcgcgttaatatgtggagtcataatttttccttatttttaataatgaataaaaatgaataaagtgcggtcattttttaccgcactttttaattgattaagataaattaaagtgctgcagcacctaagccgataaataaaccagcaatagttgcactcattaagttagcgagagtaccagcgataacggctttgatacctaaacgagcaacatcactacgacggcttggtgccataccacctaaaccaccaattaagattgcaattgagctgaagttagcaaaaccacaaagtgcgaaagtaataatcgctttggttttttcagttaatacaattgcagaatctggttgtaaatattttgcaaattcaagataacccacaaattcattaaccgctaatttcatcccgatcatttgtcctgcaatacctgcttcagcaccatcagttacaccgattaagtatgctaatggtttaaaaattaaaccaaagatagattgtaaggttaagtcgccatagccgaaccatccgcctacgccacttaaaataccattaattaatgcaattaaaccaacgaatgcgattaacattgcacctacgtttaacgcaagttgcatacctgcactcgcaccgcccgccattgcttcaagtacgttagttggtttttctgaatcattgtcttctggttgtttatctgtgaattgttcggtttgtgggaacattaatttcgcaaataataaacctgctggtgccgccataaatgacgcagcgattaagtatgtcaatggcacgcccattccagcataacctgccattactgaacccgcgatagacgctgtaccacccaccataatggcaaataattcagattgggtcatatttttaatgtaagggcgaacaactaatggtgcttcagtttgaccgacgaagatattcgccgccgctgacattgattccgcttttgacgtacccaatgctttttgtaatgcgccacctaatactttaatcacgacttgcataatgccgagatagtaaagcacagaaattaagccagagaagaacacgataatcggtaatactttcactgcaaaaatgaaaccggatggtttacttggatctgccaatccgccgaaaacgaaattaatcccgtcattaccataggcaataacattggataccatatccgcagcggcacccaacgcttgtttacctgctggcacatataaaataagggcggcaaatcctacttggattgctaacgcccctactacggttcgaatactaatcgctttacgattattagaaagtaacacggcaatagcgattaatacgaccattcccaaaatgctgcttaacacactcatttgattcccctagattagttaagttaataaaattcggcttattctacttgttttcttatgaaaagtcggcgaattttcaccgcactttttgtaaacgtctataaaatagtcaaaatcttgttaattccacattgacgcgcataagcagatagcgcattagtttcttccacacttgggatatacgctgataacccagcttcatcacgtacgcctttgctatgcacgcggataatttttaatgccacatcaggataatttcgtagtagttgagcaactttgcccaccaaatgttcagcatcaaaaaaatgctttaaaaaaaccaaccgcacttcttccactttatttaatggcaacaaggcagctaaattttgcaaattccgctccagtttatcgttttttatatgtaaacgttctggtatcacttgctgtggtacaatacctgcttgatttttccgatcaaaacaaagtgtttgcaagccaatgccctcgcctttgagatcaaataaaaatttgtcagtgacatcaattaacgaacaaacacgatcaaactcaaaaaagccactgctatccaaataacaagtcaatccttgcgaacgtaaagccttaaagagtggcacaagttttttgtgatgaatagtgggttctccaccagaaaccgttacaccgcgaataaatggaactgcctccataacctgttcatacaaatactgcaaactgaccaatttcgcactttccgtataacgaggtatggtttccggattatggcaatacaagcaatttagcttgcaaccttgcagaaaaatactcgaacgattgccttgcccctctacatttgaaaacggaataatccgatgtaacggcacaaaaatctcagaaagtgcggtcatttttctaattatttttcagcgatcacatctttttcatcgcgtaattggcgatcaaacacattggcacattcatccgtacccgagccataccaagttgtatcgcgtaatgcgacttcgcctttacggtatttttcaacttcgcttttcttcactagataacctgtaacacgaattaaatccgtgtttttcaaataggtggtaatgtagcgatagcctaaggaaaatgcaccatcaataatatccaccaccgcatcgcagtgatctacataggtttgatcaaaggcaaataaatcccctgtaccagatgggaaatatttatggaaaggtgcagattgtttcaaatgtgcaagtagcgttggttcttcacctacacgaatacggtgagccggtgcgttgcgtttgtcttcttcgtggttacttgcgcccacttgtgcgtgtaataaataacgattgccagtacgttcggcataaactccttcgtgcgcatcagtaatttctttcaatttatccataatcgctgtcgcaatttcatcgccacgaacgctcttaccaaaggtttcatttaagccttcacattgcaataagtgatttgtggcatcagccaagcccacaatcgcaaacattcctgtaaaattagtgcgtttgataaagccctctttttcgaggaatgaactgttaaagaaattactttcttccactacaaatttgtggcgtttatccatggttgaaagagcacatttcgccacacgcggtaataattcattcagcatttcatccgcacttttacaggtgcgagcaattgtccctagacgtaaacgcgttaaagtgtaggcaccgccacattcaggcagtgcgttatagcaacttgctacgccgtattcttcgcctagatcggaaatatagtaagcatcgtttgcaaaagatggtttagaaaccaacaaacaggcttttgctgcaagttcagcaaactcacggcttgttttcgatttgtcataacgaatagtcatattcggtgttggtgcttcaagatcaatcacggcgcgtaaaatcaagcgacctgctttcgtatcataaggcccaatattggcatgacagaatgaatctggcacagttttatcaatatgatttaagaaacgtttaatttttatgtaatctttttcttcatcagtaatgaacggttcgagcaacacatcaagacgcccaatataaacaggataagtcgtaatggatggcacgtgggagtaaagaatcaataatccatcaagtgcctcatcaagatcttttggaggaggcaactctaaaaattcgcagcctttttggatatacacattgtaatcaggcaggatataacgaggacgataaatcgcgtagccttcacataaatcacaaatcatttgattctgtaaaaagccccattcttcatcggtataaccaagcaaatcgcgaggatcaaataaacgctcggcaatattgcctaatgtcattaatttttgatgataagttagattattggctttaaccgtatcgagaatatcttgaagtgaagctaacataacgtcccctttgaaaatggtttcgtattgtacgcaatggtaacaaaatagacaattttgaaaacgtgaggaagatcacagttttagaaaataaacattatgcaaacggttactcaaaataaatatgtttttgatataaatgaactgacaaaattatttctgtttttgcatctttccttttatgataaaacggaatataaaaggtaataaatatgaagaaaaaagtacgcgttatacctcgcacatcttgggctgccacatcattatggacagcgcaatataaaaccatttcaatcttactttttgctctttctattttaggtattggagatgggcttattgtattatcaggtttaggatcgacaccttggactgtactttcacaaggtatagcaatacagacaaattttgatattggctggtcatcttttttaattagttgcgcagtaatgttggtatggaaacctctcaaattacgccttgggcttgggacattattaaatattatcgttattgctctatttctagggatcacaacaaaaatactggcaccgccaaccgcacttttttcacgaatgatcttctgtctgatcggtatattactctatggttttggaactgccttatatctcacttgtcacttaggtgcgggccctcgagacggattaatggttggtatttgccaacgttttcatttaagcatcaacgtggtacgctcaagccttgaaatctcggtttgtttacttggttttttacttggtggtgtcgttggcttgggtactgtccttttcgccaccagcataggcagcgttgttcaattcttcttaaatattattgctcgtttgccacatattccgtatgaaaagtgatatttcagctaacgcattgtctattgaaattaactctaaattcatttgagactcttttcctgcgggtgggcaaaatgcaatatgtttatcgacatcattaatgggtttccaacgtctcggctgagaagaacgactatttggataaaacccgatagtcggaatattaaacgcactgctcaaatgcaatggcccagtagatcccgcaataaataaatctgcacaagccaaagaatgagcaaaatccactaaacctttattcttatcgtaaatggctacgcgtaaatcattcacaagatttgctaattcataggctttttcactttcgccaggccctgcagtcagcacaacattgcaatcaaactcagccaataagcctttaattaaatccgcatattgcgctaaagaaagattcgtagctgaaccaccagaaccgctatgcacaaagatccattttttatttgcggaaagccctaaattctcttgtaaaaaaacgcgctgattttccaccgcacttttctcaaagattaaataaggcggtttaggttcaacaactggcatattatgcttttgcaaaaaagtgcggactaaatcttgattgtattccgcttctgatttttcagaacgagaacggcgttgtgttagacggtgattatagagaatttgaacccatttagtcgcaggcgcaaggcgatatttaattccacttttccaagcgagttttccattatgggtattggaaaagaaactaatcatgccatcaaactgctgcgctttgatttcctgcacaagacgtttgaaatccgttttgtcattttttttgctatcaataataacatgatcaataaatggacaaatttccgctaaagacgcagtgtaactcggcacaagtgcggttaattttagctttggatttgaggctttcaacattgcaaaagcaggccatgcttgcataaaatcgcctaatttatcgttacgaataactaaaatcttttccataatttctccgctaaaataaaaaaaccgcacttgaaagtgcggtcgtattttatgttatttttgtggattataaaacatcaacacaatttaagtcttcgaaagattgctctaagcgtttagacatagattcttccattttacgtaaccaaacacgtgggtcgtagtattttttgtttggtgcatctgggccttcagggttacctaattgaccttgaagatatgcttcatttgctttatagaaattcaaaataccattccaagatgcccattgcgtatcagtatcaatgttcattttgattgcaccgtagccaattgcttcgcggatttcttcgcggctagaacctgaaccaccgtggaatacgaaattaattggttttgcaggaagattgcgttctttagaaacgaactcttgtgattcacctaaaatagatggttttaattttacattacctggtttgtaaacaccgtgtacgttaccgaatgcagcagcaacggtaaagttagggcttactggatgcaattgatcgtaaacataaagcacatcagaaggttgtgtatataaacgtgattcatcaacatcagagttatcaacgccgtcttcttcgccaccagtaatgccaatttcgatttcaagggtcatccccattttatccatacgagcgaggtattcacgacagattgccatattttcttccattgactcttcagataaatcgatcatatgtgaagagaaaagtggacgacccgtttcggcaaaatgtttttcgcctgcatctaataaaccgtcgatccaaggtaataattttttcgctgcgtgatcagtatgaagaataacaggcacaccgtattctttcgctaaagtatgaacctgtttcgctccagcaatcgcaccaagcacatcaggacgagtaccactcgttggtttgatacctttacctgcgtagaacgctgcgccaccatttgaaaattggataatcactggtgcttttacgcgtgcagcagtttctaacacggcattaacggagtctgaacccacacagtttacggcaggaatagcaaagttatgctctttagcataagcaaaaactttttgcacatcttcgcctgttacaacaccgggtttcacaatatctaataatttagccatacttgtgtttcctttttatgtttagcgggataagcccacaatttgaagaatttgtattgatgatggcatttttgatgccaccatcaatatgttatagaggaaaagtgcggttagtttttcgcacgtttttcaagaatttctactgcaggtaatactttgccttctacaaactctaagaatgcaccaccacccgttgaaatgtaagaaatcttatcagcaataccaaataaatcgatagccgctaaggtatcgccgccaccagcgatagagaatgcatcgctgtttgcaatggcgtgagaaatgatttcagtccctttacggaagtgagggaactcaaacacgccaactgggccattccataaaacggtttttgcatttttgataatttcagccaattgttctgctgatttatcgccaatatcaaaaatagattcatcatctttcacttcatttaccactttttctgttgcagctgccgtttcagagaactctaaacctacacgcacatcaactggaactggaatatctgtatttgcggctaattctttcgcaactggaattaaatcagcttcatataaagatttacctacattgtgaccagctgccgcgatgaaagtattcgcaatgccaccgcccacaataatttggtcagcgatttttgaaagagaatttaatacttctaatttagtggaaactttagaaccaccaacaatagccaccattggacgagcaggttcttttaatgctttacctaatgcatctaactcagcggctaataatgggcctgcacaagcgatcggcgcaaattctgcaacgccataagttgatgcttgcgcgcggtgcgctgtaccaaaggcatccattacaaatacgtcgcaaagtgcggcatattttttacctaattctggatcatttttcttttcgcctttgtttacgcgtacgttttctaaaacaacgatttcgccatctttaacatccacaccatttaaataatcttgttctaaacgcacattaaagcctgcgttttttaagtaatcaacaactggttgtaaagaatcttctggtttgaattctccttcagttggacgacctaagtgagaagttaccatcactttcgcacctttttctaaggctaattttaaagtaggaatggtcgcacgaatacgcgcatctgaggtcactttgccatcttttactggcacattaagatctgcacggataaatacacgtttaccggctaaatctaaatcggtcattttgattactgacataatctatcctcttgttaagttaaaattaaaattaaaattgaaaacttttcgtattatacctacttcgtgctaggttgtaacgatttagatcaaagaaattcttatttgctttggcaattcattacctgccattttttatcataacaaataaataattcatttcgactagccctcaaatacgcattttttaattgtggattatgttgcttcatccaaccaaaaagttcatctctacttaatttttgattcggtaattttaatgcgttaaataattcctgctccttagcaaaatattgctgggcagaatcaaaggcgcaactaccgtgtttttcccattcgccttgcaataatttctcgcccggagaaatcgccaaatattgtgctaataaaccttttggcaaggcgggtaaatcgcctttgcaaaaacgaggatgatctgaaacagcgcgagcatttgcattttgtggccatagcccatgtacaacccaaccaaaagtgcggttatttccacattgatattgagaggaataaggcaactgatcgccatatttttcacgctgaatatcacaaaatccaggcgaccaagataatgccaacatataataatcgacaggtgcctttgcattttgcccaatatgatcattgcgcataatcacatcatagtttgcaaaaacatctggattttttaccgcacttttttcaatatccgtccgctttgtctcaaattgaggctcgaatttaggttcaaatttaggctcaaatttaggctcaaatttaggctcagatacttttgtttgcttcgtctgctcaattacgggcgaagatgattgatgtttagttttggttgtatcggtaaaatattgccaaattgctaatataacgagaacaataagagaaagaatggaagtaagttttttcataaattttgtttagtttttgtcaatcaagtttttgtcggctataattcgccgctttcaactctctattaaggatcacaatggcattactcatcactagcaaatgtaccaactgcgatatgtgcttgcctgaatgcccaaacgaagccatttccattggcgatgagatttatgtgatcgatcctatactttgcacggaatgtgtcggccattacgacaccccaacctgccaaaaagtttgcccaatcactaactgtattaagcccgatcctgaacatcaagaaaccgaagaacagctttgggaacgctttgtgatgattcatcattcggataaattgtaatttttaaagcaactgaaatatgacttattatcttctaaaagagtgcggttaattttgagcttatttttattatcaaaaaacgaaatttttcaccgcacttttatctataaaaagaactacattgagttacttttcttcacattaccccgccaccactggtaaatatccccattgaattaaaaatggaatgagcataatcacgacgccaattaataacgcaagcaccaaagcaaaattaccgccagcgactcgatatggcaatgttggattttcaatacgtgtacgccatgccaagctaattggtaaaattaagcaatagaacgcacacaacaaaccagcgtaacttaatgcagtaataaatccttcaggataaaacaatgcaaatacaagtggcggtaaaaatgcggcaatggttaatacaaagcgattatttggcaaatgataacgcttgaataaatcccccaatccctcaaatacaccaagcattacgcctaagaaagaagtgatcagtgcaagtgatgagaacacacgcacaacctctcccataaaatgagaacctgtaatttcacgcgttgcattcactaagccatttagcgttgggtcagcttgtaaaatacgcacaaattcactttgacttaatacaccatgagttgctaactgccatacaaggtaagcggctaatggaatcgcagtaccaatcaaaatggcacgacgaaatttatcaacacttccacctaagtagctattcacactcgccataataacgtggaaaccgaaagaagttaaaaatattggtgccgcagaaaccacaaaagcataatccaaaggcaatgccattaaattatctgttgctacttttggaagcatcataaacagcacaaaagcaaaggcgattaacttaccaataaataacacgcgagttaagccatccacgcctttcgttcctacaaccacgaaagaacctaataccaccgtaaagataataatcgccgttttaagcgacatcgcttccattccaaacgcagttggcaagcctgaaagtaaagatccaccaccagtaatataagcggctgaaagtgcataaagtaaaactaacaaactcaacgttgcgaaaattcgcccaggaaccccaaaatatttttcagcgagcgtggcgacaccatcatccaactgatccgctgtttgatacacttctacaaacaacaatccgctgtaaaccaacaaagcccacaagccaacgagcaataacagggtataaccaaagcccatacctgctgatgtaagcggcatagcaagcatacctgctccaatggttgtgcctgcaataatcagcgcactcccaaaagttttgttttttagcataaaattgtccttataatgttgtgtttaaaaactaatttaaatttgaccgcacttttctttatagtgtaaacggcaaacagaaagataagaatcattgcctccaatttgaatttgtgcaccttctttaatgacctcgccctgatcatttaaacgcaaaacaaaattagccttgcggccacaataacaaattgtttttaattcttcgagttgatccgcccaagccagtaaatatttacttccttcaaaaagttccgcttggaaatctgtacgcaagccataacaaagcacagggattttgagtttatcaacaacatcactcaactggtaaacttgttgtttgctaagaaattgagcttcatccaccaacacgcaatgcactttttctttttttaaatgctcattaatttcatcaaacaaattggtttccgagcgaaataaaaaggcatcttgcgaaatgccaatacgcgatgtgacttttcccacgccaaaacgatcatcaatcgcagccgtataaactaatgtgttcatatcacgctcacgatagttataggaagattgtagcaacgtcgttgattttccagcgttcattgtggagtaatagaagtagagtttcgccattttttctcctaaattgccggtaattccgccattgcccaacgaggtttaacatcaatagccagatcgctatgctgaccttgttttaaacgtaaaaaacctgtgtaagcaatcatcgcaccattatctgtacaaaattgaggttgaggataaaacacttcgccacctaaattttgcattaagtgcgcaagcgtttctcggagttttttatttgcgctcacccctcccgcaatcactaaacgtttatagcctgtttctttcaatgcacgcttacatttaatggcaagagtatccaccaccgcatcttggaaagcataagcaatatctgctttagtttgctctatcagttcgccctcgtttttaattgcttgattaactgtatttgcggcaaatgtttttaaaccagaaaaactaaaatcaaggcctgcacgatctgtcattggacgtggaaatgtgaaacgatttggcgtacctttttccgctaaacgagaaagtgccgcgccacctggataatctagtccaagtaattttgctgttttatcaaaggcttcgccagcagcatcatcaatagattctcctatcacttcatattttcctacaccatcgacacgcactaattgagtgtggccacccgataccaacagagcaacaaaaggaaagtgcggtgaattgtcatcaagcattggcgcaagtaaatgcccttccatatgatgaacaccaatcgcaggaacattccaagcataggctaaagaacgtgcaatcgtagcaccgacaagcaatgcgccaacaagcccagggccactcgtataagcaataccatcaatatcgctcgcggttaaattggcttcctctaatgccgctttaataagaggtgctgttttccgaatatgatcacgtgatgctaattcaggaaccacaccaccataatctgcatgcagggcaatttgagtataaagttgattagcaattaatcctttttcttcatcataaatcgccacgcccgtttcatcacaggaagtttcaatgcctaagattttcattgattttcttaatttattacctaaaatgttgcgcgattttaccctgtttaagcggttttaaccagttgaaaccacaaatattaaggtgaattggcattctatcctttactttttccctaaaaatagattagaattgcgtcctttattaaatttgtcatttacacacaggtgctttggcaaaaataaaattttaaattgcaattaaattaaactcattgaggtgattggcttatgcctgtaattaaagtacgtgaaaacgaatcatttgacgtagctttacgtcgtttcaaacgctcttgcgaaaaagcgggaatcttagctgaagtacgcgctcgcgaattttacgaaaaaccaactacaattcgtaaacgtgaaaatgcaacacttgcaaaacgtcacgcaaaacgcaacgctcgcgaaaacgcgcgcaatacccgtttatactaatttatagtattttctgactcgagttaagacaaaccgtgaatcctttggactcacggttttgttactttaagcacaacaaaaatctacgccaaaaacgaccgcactttcacaccacgatcacggaggctcgacaatgaaaggttctattcctcgcccctttattgatgatttgctgacaaagtccgatattgtcgatgtgattaacacgcgcgtaaaactaaaaaaagctggccgcgattatcaagcctgctgccctttccatcacgaaaaaacaccatccttcacagttagccaaaagaaacagttttatcattgctttggttgtggcgcacatggtaatgcgatttcctttttaatggattatgacaaacttgaatttatagaggcgattgaagaacttgcagcaatggcagggcttgaaataccttacgaaaaacgcgttaatcacagcggaaaacctcaagctaattaccaaaccaaacgaaatctctatgaattaatgcaagagattgccacgttttatcaaaaccaattaccattaaatactcaagcacaagaatatttacaacaacgtgggctttcacctgaaattattgagcgtttccaaattgggtttgtgccgaatgcaatggatactgtactgcgtaaatttggtgttaatcgtgaagaacaacaaaaactcattgagttaggcatgctttctcgaaatgatcgtggcaatatttacgataaattccgaaatcgcatcatgtttccaatccgcgataaacgtggtcgcacagtggcttttggtgggcgtgtattaacagatgaaaaaccgaaatatctgaattcgccagaaaccattacttatcataaaggtaaggagctttatggtttgtatgaagccttgcaaaccaacgatgaacccaaacaattacttgttgttgaaggttatatggatgtagtggcattagcacaatttggcgtggattatgcggtcgcttctttagggacatccacgacatcagaacaaattcaacttattttgcgttcgaccgaacaggttgtttgttgttacgatggtgaccgtgcagggcgtgatgctgcttggcgcgcactagaaaatgcgttgccctatttagaagatggcagacaactcaaatttattttcttgccagatggagaagaacctgatacttacattcgtcaatacggcaaagaaaaatttgaagaatacatcgaaagtgcgcaatctttaagcgagtttatgtttgcacatttaagtcctcaggttgatttttccactaaagaagggcgtggaaaattagttgcgctasstgcgccgttaattcaccaaattccaggagaaatgcttcgcttatcgctacgcaatatgcttgctcaaaaacttgggatttttgatcaaactcagctggaaaatcttattcccaaaaaattagaacaagccaatacacaacaaaaagtcactcataataagatcaagaagacaccgatgcgaatggtcatttcattgcttatgcaaaatcctgagttagtaaaacgtatgtctgaaagcggcgtgcaagcattacgtgcggaagcagggtttgaaattctggaaaaattgaccgcactttgtcgccaacgagagggcattactacggggcaaattttggaatacttccgcaatacatcttacagtaatccccttgaaatactggcgacttgggatcatttattggacgaatccgacataatcaacgcattttctcaaaattaccgtcgcttaaatattcaagctattgagcgcgatattgaaatgcttattgctaaagaacgaacagagggtctcactaatgaagaaaaaacggtacttgtacatcttttagctggtaaagnacagcagnaaaaacagttagtgaatccgctataacaatggtagaatctcaagttcataaaaaatcttatcttctcaatcacatcaagcaaaacgagtataaaaatggaaaaaaatcaacaatctacggctgaacaatattcagaacaaattgagcaattgatggagctaggtcgtacacaagggtatttaacttttgctgaaatcaatgacttattgcccgaagatgctattgatcctgaatattacgacaaattgctacaaacgttgcaaaatgatgctggtatccctgtattagatgaagcaccagaaagcgatgatatgatgttgagtgataccatccctgatgaagatgcagtggaagaagcaactcaaattctttcaaatgtagaatctgaaatcggtcgaacaacggatcccgtacgcatgtatatgcgcgaaatgggaacggtggatcttcttactcgtgaagatgaaattagcattgcaaaacgtattgaaggagggattgatgaagttcaaacctctatctcagcctatcctgaagcattaaatggattactaaaaaattatgatgatgtagaaaaaggtaatttccgtttgaccgatttaattacgggttttgttgatccaaatgccgaaatagaagaacacaacggacttgatgaagacttttctgacgaagatgatgaagaagaatctagtaatgcagatgtggaagacaatgaagatgaagaagacaatgaatcagaatctacatcagattcaagcgactctgataacagtattgatcctgaagttgctcgcgaaaaatttcagcaattaagagaacagcactctaaaacccttgctgttattgaaaaacacggtcgctctggaaaacgtgcccaagatcaaattgcactacttggcgaaatttttaaacaattccgtttagtaccaaaacaatttgatttactcgttctatcaatgaaagaaatgatgaaacgtgtgcgctaccaagaacgtcagctacaaaaaatattagtggatatagcaggaatgccaaaggatgattttgaaaaaattattaccactaatggcagtaacagtgaatgggtagcaaaagcattaaaatctagcaaaccttgggctaaacgtttaattaaatatgaagatcgtatttatgaagccttaaacaatctagcgataacagaagaaaatactaaacttaccattactcaaatgcgtgacatttgcgatgcagtcgcacgaggcgaacaaaaagcacgtcgagctaaaaaagaaatggttgaagctaacttgcgtttagtaatttccatcgcgaaaaaatacacaaatcgaggtttacaattcttagatttaattcaagaagggaatatcggtttaatgaaagcggtagataaatttgaatatcgacgtggctacaaattctctacatatgctacttggtggattcgtcaagcaatcactcgctctattgcggatcaagcgcgtacaatccgtattcctgtgcatatgattgaaacaatcaataaacttaatcgtatttctcgccagttgttacaagaaatgggacgtgaagcaacaccagaagaattggcagaacgtatgggaatgccagaagataaaatccgtaaagtactgaaaattgcaaaagagccgatttctatggaaacacctattggcgatgacgatgattcgcatttaggggattttattgaagattcaaccttagaacttcctcttgattctgccacagcacaaagtttaaaagttgcaactcacgaagtgctagaaggcttgacgccacgtgaagcaaaagtattacgtatgcgttttggcattgatatgaataccgaccatacacttgaagaagtgggtaaacaattcgatgtaacacgcgaacgtattcgtcaaattgaagcaaaagcattacgtaaattacgtcatcctagccgttctgaaacactgagaagttttttagatgaatagagagaaacataaaagaggaaaatcgatctaatcttaaaaaatcagatacatttgtttaaggactaaattctataatccgcagaatttagtccttttacttttacttaaagcaccgcattaatatgcattcaaatttcaactattttagttagataagccattaacatttaacaatggcaacaaatattggttatttaaaccattttaatcataaaaaaatctgcaccccaattagctggtttatttattcagctttaaggcacagattaaagtgcggtaaatttttttgatatttggcgtaaattatttatttaatttcgctttgtaagttggattcattaagttttctacagaaagaatgtcatctaattgttcttctgttaataaacctttttctaacacaacttcacgtacgcctttgcctgtttgtgcacagattttacccactaagtcgccgttgtggtgaccgataaatggattcaagtaagtcacaataccaattgaattaaacacgtagttttcacaaatttctttgtttacagtgatgccatccacacatttatcgcgtaagttcacacaagcattggttaagatatcgatagattcaaacattgcttgaccaatcactggttccattacgtttaattgtaattgacctgcttcagatgcgaaggtcacagtggtatcgttaccaattactttaaagcacacttggtttaccacctctggaacaactgggtttacttttgctggcataatagaagaacccgcttgtaattcaggaagattaatttcttttaaacctgcacgtgggccagaagaaagtaaacgtaagtcattacatactttagaaagtttcactgcagtacgttttaatgcaccgtgaaccatgacataagcaccacagtcagatgttgcttcaattaagttttctgctggtacacaagctaatccagtcacttcagcaagatgttttacaactaattctgtatagccttgtggcgtatttaaaccagtaccgattgccgttgcaccaaggtttacttcaagtaataaacctgctgtacgttttaagttacgcacttcttcttcaagtaatacggcgaaagctttgaattcttgaccaacagtcattggcaccgcatcttgcaattgggtacgacccatttttaagatatttgcaaactcttttgctttattatcaaaactgtcgtgtaaatattgaattttatcgatcaattttaagatgctgttgtacaccgcaatacggaaaccggtaggatacgcatcgttggtcgattggcttgcattaacgtgatccatcggattaatcacgttatattcgccttttttatgaccaattttttcaagggcaagattagcaaccacttcattagtattcatattgacagacgtacctgcaccaccttgatatacgtctgatgggaattgatctaagcattttccagtggtaagaatttcatcacaagctgctacaatcgcttttgcaatatcacttggaattgcacctaattcgccattggctaaagctgttgctttttttaccattaccataccacgcacaaactcaggcacgtcagaaatggttacgttagaaatattgaaattttctaccgctcttaatgtatgaatcccccaatatgcttctgcaggcacatcacgttcgccaagtaaatctacttcttttctaaattgagtcattgtaatcacctttttgggttagttaatttatcgtcattatagaaatttcaagaagaaaaaacttgatgaagatcacattttcaaaaaatgctctcaagacatattttcatttttcggattagttttttwagggaaaaatgttctatctatcaatcttacacagatttcaatagcctaccaattttctcaaataatttctgaatttgcctctgcacgacacccgagtacccgcaccattaaaccatattcattgagttgtgatatgcctatcagtagatctttttcttctgtactttgttgctgcaaggcttgcacctgtngtttgatttccgcattatttttcgccaaatttagataagtcagcgaaccttgatgggaataattttccatctggcttaaagcggtaaggttcattttagacggcagccactggatacaatcactgacaagcggtcgttttttgccatcgttttgcaaagcgtaaatcttcaaatgggaagaaaactgacggaaggcaaaacgttcatcattcaacacccgcccaatcgccacgatttcaccgtaaatcagctcgctttgttcgcccatttcaatctgggtttgctgcttaaaaacggaatctctatgtaacaccaacggatgcggcaaatagaataaacgactgttttccgcaagcaaaatatgggttgtttgcatcgcactgtcgccttcattcatcgcctgcacccgagtaaatgcctgcgtatttaaagaaagtgcggtcaattttgccaatgaaatatcaatctctaacagatcgcccgccagcacgccaggggaggacgacatctgcatcgcattcaagccattcgcccacgcatcatcgtaacttggcaacgttatcactttaaacggtggcgtcgcaaagtattcagcaagctgggttttaccgctggaggaaagtttggtggaaagggataatttgctgttcatagattttgtaggggctaattatattagccccgatatttcaccaataattgggcaaatgtaattcacccctacgattaacgaaccaaagatgcaggttcttccacattcttcaacaacgcatatttttcgatccaaccgatcacgccatccagattttcttttttcatcaggttggtgaaaataaacggctgaccgttacgcatacgacgagcatcacgttccatgacgcttaagtcagcaccaacgaatggagcaagatcagttttgttgatcacaagtaaatctgaacgagtgatacctggcccacctttacgagggattttttccccttgagccacatcgatcacaaaaatcgtcacgtctgccaaatcagggctaaaagtcgctgaaaggttatcgccacctgattcaatgaacacgatttccacatcagggaaacgagtcaccatttcgtccacggcttctaaattcatcgaggcatcttcacgaattgctgtgtgcgggcaaccgcccgtttccacgcccataattcgctctggtggaagcaaactatttttcgttaaaaattccgcatcttcttgggtgtaaatatcgttagtaatgactgctacgctatattttgacgctatttcacgagtgagtttttcaattaacgccgttttacccgccccaacagggccagccacgccaattttaatgtagttacgcataatgttccttttgtttatcatcgtagcaactgtgttgctcatgggtgtaggggcaagttacatttgcccctatatatcaacgaatgttcaagggcaaatgtgatttgcccctacaagtaaaatctcaataaaaaataaccgcacttacgacatataaagtcgcgtataaagcacttcgtgttgcatagcccgaatatcattcgccagcgttgccgcaccaagccattcttcgtcagggtcaaggcttaattctaccgcttgtacgagcgatcctcgcaagtcaaacaaaatatcttgtccatccatttggctgagaggaattagcttcacgccgttagtgattacaccaactgctgcgttgtagtagaacgcatagagcgtatctgctttgcttaaacccatggcttgagcgaccatcgcaaacactattgggaaatagccctgtactcgtttttctgcaatcgcttgctggtaagctgtgagcaacgtatgtgtttcatagcgaataaaaattttcagcaatcgtacgccgagtttgaaactcccttcacgactttcgcgtgccactttggtggcggaaagttgccaatccagttcgcacaagcggtcaaaattcccctcacacattgcatcaaaggcaagagaaagatacgccccgtcgttgtaaatccagttttgtaaaagctgggtttgcacatattcttctagggtcgctttgctttctaccacacgttgctggacgaaggtttccaagccattggaatggttaaatccaccaatcggtaaagttggatcgaccaagtgcaacaacgcacctaaatccgttaaagagcggtttaatgtttgtgccaatgtccatctccgtgatgatgatagccatgatgatcatgcgaatggctatgagaatgtccgtgcccttgtgcagaatttgctcttaacgcttggcttaaacggcgttctgctttttgcggatgaaatcccgcagcttgcagccattcaaacatcggcttatcgtaaggtaatgttacttcatcgccatctaaaaaaagcggcgaatgtttgttgccgatttcataacacgctcgtgccatttcaggcaaggttttcggcgacagcacaatcacgtcactcggtaaaatttcaatcgcaatcactaattcatcgctgataaacactacatcatcgtgtttcaagcgttgcccctcttttagcaagcgaaatgctacttcacgccccgtatttgtagttttacgcaaaatattgcgttcgctttcataccactgcaatgccacgcgttcaatgggctgtgtggtaattttgccctctgcttgaagtgcggttaaatttcccaagatattttctataatagggagaattgggttaattattttcatctttcctctataaatccactttcttctcttcgaaagaaaaactacagctacaatgatttcttatttatcaagtaagaggcgtatcgtacacgcccttttacactaattcgtctatgaaaacagtcctttagaataggaaatatcgctgacccaatggtacgctatccactggttcacaggtaattaactctccgtccactcgaacttcataacgttcagcatcaacagtaatgtttggtgttacatcattatgaaccagatcttttttacctacgttgcggcagcctttcacagcaatggtttctttgtgtaaaccgaacttcgcacgaatatcagctttttcagcggcttgtgaaacaaagaatactgctgtttgtgcggttgctaagccttgtgcaccgtacattggacggtagaatacaggttgcggtgttggaattgaggcatttggatcgcccattttcgcatagctaataaagccttttttaatcaccacttcaggttttacgccaaagaacatcggtttccataacacgatatctgcgattttacccacttctaacgagccaatatgctccgcaataccatgtgcaattgctgggttgatggtgtatttcgcgatatatcgtttaatacggaagttatcgtttccttcattacctagctcaccacgttgcattttcatcttatctgcagtttgccatgtacgaataacgacttcgccaatacgtcccatcgcttgagagtctgaactcataatggagaagacgcccatatcatgcaaaatatcttctgctgcaatggtttcagggcggatacggctatcggcaaaagctacgtcttccggcacgcgtttatctaagtgatggcaaaccatcaacatatccaaatgttcatcaatggtgtttttggtaaacggacgagtcgggttggttgaagcaggtaatacgtttgaatacatcgctgctttaatgatgtcaggtgcatgaccaccacctgcgccctccgtatggaaagtatgaatgactcgtccatcaatcgctttcatcgtgtcttccaaaaagccactttcatttagcgtgtctgtgtgaatggccacttgaatatccatttcatctgctacttttaaggcagaatcaatcacggcaggcgttgcaccccagtcttcgtggatttttaaacctaatgcacccgcttcaatttgctcacgcagaggatctagggttgaacagttgcctttaccaaaaaatccgacgtttaccggcaaggcttctgccgcttgaaacatacgttccatataccatgcgccaggggtacaagtggttgcgtgtgtaccatcagcagggccagttccaccaccaattaacgtggtaacgccactttcaattgcatgttgtgcttgttgtggacaaataaagtgaatgtgggtatcgataccaccagcggttgcaattaaatgtgcaccgttatgaacttccgtgcttgcaccgataatcatatttggtgtgacgttatccatggtgtcagggttacctgcttgtccaatacccacaatacgcccatcacgaataccaatatcggctttgataatgcctaatttagcatcaatgatcatcacgttggtaatcacaaaatccaatacattcggattgtcgcgagttgccgtaccgctttgagccataccatcacgcacgcttttaccgccaccaaatttacactcatcacctttggtcaataaatcttgttcaatggttgcccataaattggtatcgcctaaacggactttatcgccaactgttggaccataagttgctacatattgcgctcttgaaattgttaatgccatcttgccctaccttataatttgccatcaatttgattatggaaaccataaatgatttggttaccaccaaaagcaactaattccactgatttcacttcaccgggttcaaaacgcaccgcattgccagatggaacatttaagcgcattccacgtgccaaagtgcggtcaaatttaagggcattattggtttcaaaaaaatggtaatgcgagccaacttgaattgggcggtcgcctgaatttgttacttcgatttttacggtttttctgccgacattagcgagaatatcgccttcggctaattggtattcgcctgggatcatatctttgttccttgtagggtgggctttagcccaccattgatatttttattttgtgggctaaagcccaccctwcggttatctgattggattatgcacggtaacaagtttcgtgccatcggggaaagtagcttcaatctggacttcatgaaccatttccgccacaccttccatgacatcatcaacggttaaaagtgttgcgccatattgcatgacttccgctacactcattccttctcttgctgcctcttgtaaatgactagcaatataagcaatagtttctggatagtttaatttaacgccgcgtgctttgcgttttgccgcaagttcgcccgcgaggaaaagcatcagtttttcttgttctctggaagttaagtgcatattttcattccttaatttattatacgaaagtcagcgaattttacgtaaaaaatctaaaataggaaaaatattttgtcagaattttttgtaagccccttgaaagaaaaaaaatcctccttatatagaaaccgcacttacaaattattaagaaggaaattaatcatgaatattcgtcctttacacgatcgtgtaattattaaacgtgaagaagtcgaaacccgttcagctggcggtatcgtattaaccggttcagcagcgactaaatcaacccgcgcgaaagtattagctgtgggtaaaggtcgtattttagaaaatggcaccgttcaacctttagatgttaaagttggcgatatcgtaattttcaacgacggttacggcgtgaaaagcgaaaaaatcgatggtgaagaagtgttaatcatttctgaaaacgacatcctagcaattgtagaataattattaaataagggaaaagaaaatggcagcaaaagacgtaaaatttggtaatgacgcacgcgtaaaaatgcttaaaggcgtgaatgtattagcggatgcagtaaaagtaacccttggcccgaaaggtcgtcatgtaattttagataaatcatttggcgcaccaactatcactaaagacggtgtgtctgttgctcgtgaaatcgaattagaagataaattcgaaaacatgggggcacaaatggtgaaagaagtggcatctaaagcaaatgatgctgcaggtgacggtacaactactgcaactgtacttgcgcaagctatcgtaaatgaaggcttgaaagcagtagctgcaggtatgaatccaatggatttaaaacgtggtattgataaagcagtaagtgcggttgtttctgaacttaaaaatttatctaaaccttgtgaaacagcaaaagaaattgaacaagtagggactatttctgcaaactctgacagcattgtgggtcaattaatctcacaagcaatggaaaaagtgggcaaggaaggtgtaattactgttgaagatggtacgggtcttgaagatgaattagatgtggttgaaggcatgcaattcgaccgtggttacctttctccatatttcatcaacaaaccagaaactgcaaccgttgaattagataatccatatcttcttcttgtagataaaaaaatctctaacattcgtgaattacttcccgtgttagaaggcgttgcgaaagcaggtaaaccgttattaatcatcgctgaagacgtggaaggcgaagcgcttgcaaccttagtggtaaacactatgcgcggtatcgtgaaagttgcagccgtgaaagcaccaggttttggtgatcgtcgtaaagcgatgttacaagatattgcaattttaacagcgggtacagtgatttctgaagaaattggtatggagcttgaaaaagcaacattggaagatttaggtcaagcaaaacgtgttgttatcaataaagataacacaaccattattgatggtatcggcgatgaagcacaaatcaaaggtcgtgtggctcaaattcgtcagcaaatcgaagaatcaacttctgactacgacaaagaaaaactccaagaacgcgtggctaaattagcaggcggtgtggcagtaatcaaagtgggcgcagcaactgaagttgaaatgaaagagaaaaaagatcgtgtagatgatgcattacatgcaactcgtgcagcggttgaagaaggtatcgttgctggtggtggcgttgcattagttcgcgcassagcgaaagttgcagcaagcctaaaaggtgacaacgaagaacaaaatgtgggtatcaaacttgcattacgtgctatggaagcgcctttacgtcaaatcgtcactaacgcaggtgaagaagcttcagttgtggcaagtgcggttaaaaatggcgaaggaaactttggttataatgcaggaacagaacagtacggcgatatgatcgaaatgggtatcttagatccaactaaagtcactcgttctgcattgcaattcgcagcttctgtagcaggcttaatgattaccactgaatgtatggtaactgatcttccaaaagatgataaagccgatttaggtgctgctggaatgggcggtatgggtggaatgggcggaatgatgtaattcgcttatacgagtaaaaaatctatcccaacagaaaatttgagccctatatgacttagggctcaaatctactaaaataagggatattttttattaccctattctaaatttatatatgataaaaataaaaaaacccagttttaaactgggttttattttatctattggataaattattctgcaacaacgattacatctaatgccgcaaatacttcaccgtgaagttggaaacgaacatcgtggtcaccaagagtacggattggaccgtttggtaaacgaacttcacttttcgcaattttaacgcctgctgcagttactgcctctgccacatcacgagtagtgattgcgccgaataaacgaccttcatcacctgctttagatgcgatagtcacagaacctaatgcagtaacttctgctgcacgagcttgagctgctgcaagatttgctgctgctgtcgcttctaattctgcacgacgtgcttcaaagtgttcaatgttagctttagttgccataacagctttaccttgtgggattaagaagttacgtgcaaaacctgatttaacatttacttgatcgcccacttgacctaagtgaacaattttatctaaaagaattacttgcattaccgtgtctccttaattactgatgattgtcagtgtatggaagtaacgctaaatagcgagcgcgtttgattgcacgagctaattgacgttggtacttcgcacgagtaccggtaatacggctaggtacaattttgccgctttctgaaatatagttctttaatgtagcgatatctttgtaatcgatttcaacaacattttccgctgtgaaacggcagnacttacgacgacggaaataacgtgccatttggctagtctcctaatctataaattcgatttgctcggcatgtaaaactaattggcataacccactttgggttttatgtgatgtaataaatcccaccaccaaaattttactaccgaccgtaatgctttgagttttttctatcaattgattaccactaatttgaacaggcatttttaaccaagcttgacgtgtgaaaccactttcaatctgatcagaacgatgttctaacaaaaacttgcaatgctcaattccactagggctctttaatcgctttggtaaccgagaaacgactcccataaccgaaaaactattatcaattttcaaattactcttcagcatcctcaaaatcgttgttttcaacttcagctaaaggtttacgttcttctttagccgctttcattggggacgcttcggttacggcgtgcttagtatggataacaagactgcgtaatacagcatcgttataacggaaagtcgtttctagctcgtcgatgacttgttgaggcgcttctacattcataagcacataatgtgctttgtgtaatttattaattgggtacgctaattggcgacgrccccaatcttctaggcgatgaacttgaccaccagcttcttttacagaaccggtgtaacgttcgatcatacctggtacttgctcgctttggtccggatgaaccataaacacgatttcgtagtgacgcattactgctccttacgggttaatcagcctttgacgtrgatcagccaccaatctgcaaaggcaaggaacgaaaaattcaatgtggctaagggttgcggattataccgattttttnacgctccgcaaccagtttgagttctttttgaacaaaaaagaaggtcgatattgtaacaatatcgaccnatctcaaatcttctgtaattaacgactacggaaaataatacgtcctttacttaaatcataaggcgtcatttctacagtcactttatccccagtcaaaatacggatatagtttttacgcatttttccagaaatatgtgcagtaaccacgtgaccgttttccaactccacgcggaacatagtattcggtaaagtctctaaaattgtgccttgcatctcaatgcaatcttctttcgccattgtatcctctaaaaataatcgattttttatccgcactttaggcggaaaagttaagaaaaacgggcggattatagccgtttttagctttctacgaaagaaaaaataatattgttcatgaaaaactcaatttggcataacctaacaatgatttacaaagctaaaacaacccctataataaccgcacttttcttattaaatagtacttatgaactcaaaaaaacacttaggccatacggcgcgtaaacgctttggtcaaaactttttacatgatacttctgtcattcaaggtatcgtggcggcgatttacccacaacctaatcaattcttagtggaaattggcccagggcttggtgcattaacagagcctgttggtgaacttgtcgatcatctgactgtggtagagcttgaccgagaccttgcagaacgtttacgtcaccatccatttttacatcaaaagctcaccgttattgaaacggatgcgatgcaatttgattttggtgcgctttacacaaaagaaaatttagcagaaaaagggcaaaaattacgtgtgtttggtaacttaccttacaacatttctacgccattgatgttccacttgtttaaatatcatgatgtgattcaagatatgcactttatgctgcaaaaagaagtggtaaaacgcctatgtgccgcaccaaatagcaaagcttatggtcgtttaacgattatggcgcaatatttctgccaagtgatgcctgtgcttgaagtaccgccttcggcattcaaacctgcaccgaaagtagattcagccgttgtgcgtttaattccgcataaggaattgccgcaccctgtaaaagatttatattggttgaaccgtgtttgctcccaagcgttcaatcaacgtcgtaaaacattacgcaatgcactctcaactctattttcacctgaaaatctgaccgcacttggtattgatttaaatgcacgtgcagaaaatttggctatcgcagattatgcacgtttagcgaactggttagcggataatccaccagcagatgtcaataaagatgaaatcttagattcagaagagtaaaaataataaaaaggtgtaacccttgttacaccttggctttctacataaaacgaacaatttctttaccttgcatttctttaatacgttgttgttctttccatttttttctatttaaagctcgtataatatttycttttatccgagttaaacgctgtttcaatgtctttttcttacggatttttgaacgtttttgtcgttctttttccaatccgcttgttaatacacttttactttgattcgcttggagttcttgaatacaaattgctggattcagttgatagacaatataattatcaacatcaactaatttattaaaaataagttcatcaactgcaacaatttcatcagaaggaatattctttaaatattcaattacatatttagccgcaccttgagaaataatataacctgccgtcccccagtgagttgattttaaaatatcaaagttcctagaattaaaaggtggaattttagtttgtttctcaagtttaactggctgtaaaaaagtttctaaacgaataataaaaatatcattaaaatcaaaacgtgtttttaaccattcattttggttcaaaaatacttccgcattctcgccaagaattacatcatcttcaaaaattttgagatattcaaaattttcattcacacacttattccataataagaaatggctaattaaacagcctttttctcctttagtaagtattctagattcctctatattatgtaatatggagtttgattgattgattgattgattgattgattgattgattgattgattgattgattgattgattgattgattgattgattgattgattgattgataagtgtacgcattaaagaaactaaatgaaagtttttttgattcaaattgcttagtaatatgtttgcgacgttcagttgcattttccatactaatgacaatattttcaatagcactcatatttaaataaaaatggaaataactaaatttttcgcattctactatacaaaaagaataaatcaacaataaaagtctgtgttaaaattttcaaaatttatttataaaagagcggtcaaaaatggcaacctatttcgtcggtgatttgcaaggctgttatgatgaattacagcttttattagaacgtgtagatttcaatcctacgcaagataaactttatcttgtgggggatcttgtggcgcgtggggataaatcacttgaatgtcttcgttttgtaaaatcacttggtaatgcagcgcaaaccgtactaggcaatcacgatttacatttaattgcgaccgcactggacattaaaaaagtgaaaccgcgtgatcgtgttgatgccatttttaatgcgcccgattttgatgagctgattcattggttacgtcatcagccattacttgtgcataatgaaaagttaaacttcctgatgtcacacgcaggcatttccccagattgggatttgaaaactgcgaaatcttgtgcggctgaagttgaacaaattttacagcacggcgattttcattatcttattgaaaatatgtattctgaacagcctgatcgctggtcgccagatttacagggcttagcacgtcatcgctacattattaatgctttcactcgaatgcgtttttgctatttggatcatcgctttgattttgcctgtaaatcccctttaaaagatgcgccacggagctcacaccttggtttaatttagataatccactttataaacaaattcccattgtctttgggcattgggcaagtttagtggatgagcctactccaaaaggtatttatgccttagatactggttgtgtgtggaataatcgaatgactatgttgcgttgggaagacaagcagttcttcactcaaagtgcggtcaaaaattacagtgatttttaaggaaacgctatgctctcgctcactgctgaatcttgcgaactgttcaacattcctttctaccaattcgcccaaatgaaaaaattctgcccagaagatattccagcgattaaagcggattacaaattacattgggataattggaaagcgataattcaatctgtttcagcacaactcggtacgccttttgcgaaaccgcatattgaaagctggaccaatggttggcaagtgcgggctcatttcttcgcttattttaaatacgagtttaaccaaaattctgccgcaatcttttctgtgctattaaatcgtcgccgactaagagtgtgtttagattggcattgctatcgtgcagatcgctcacaaattaatgtgcaacaatataatcagtggcttgatcaatttgatttcaaacaatttgctgattttgagatttggcgagaggatgaaagtgaatatgatgattttcgccaagtgaaggtcatttctgaaaaaaatctgatcttacgttcagatgaggatttttggtgcattgggaaaagtattgaaaaagccgagttaaatcaaatagatcccgttttatttattacgcacaccattcaacaattacaaccgctttacgatcgctgccatcaataaagtatacccttagtataaataattgagctctacattatgcagagcccaatatttcagcaaattaataaactatccaaatttatggcaacagtttaaagtgcggtaattcttattgatgtttttaactacacatcataagtagttgatgctgtattaccgccacgaccagtccagttagtgtggaaaaactcgccacgaggtttatctgtgcgttcataagtatgagcaccgaagtagtcgcgttgtgcttgcaataagtttgctggtaaacgtgctgaagtatagccatctaagaaagtaatcgcagacgccatacaaggcattgggatacccacttcgatagattttgccaccactttacgccagtcacttaatgcgttttctaaaatgcctttgaagtagctatctgaacctaagaaaacaagatttggatttgcttcataagcatcgcgaatattacctaagaaacggctacgaatgatacaaccttcacgccataacaacgccgttgcaccatagttaatatcccaaccaaattgttcagaggcttcacgaatcagcataaagccttgtgcgtaagaaataatttttgacgctaataatgctttacgtaccgcttcaatccatacttttttgtcgccttcaactggtgtaatagttttgccgaataattgattagccgcaacacgttgatctttaaaggaagacacgcagcgtgcaaaaacggattcagtgattaaagttaatggaataccaaaatctaacgcattgatacctgtccatttacctgtccctttttgacccgcagtatccaagattttttcgactaaaggttctccacttgcatctttataaccaagaatgtcagtggtgatatcgattaaatagctatcaagttcagtatttttccattctgcgaagatggcttgcatttcttcatagcttaagcctaaaccttcttttaagaattggtatgcttcgcaaattaactgcatatcgccatattcaataccattgtgaaccattttcacaaaatgaccagcaccttcgccgccgacccagtcacaacaaggttcgccttgttctgttttagctgaaattgcttggaagataggtttcacatactgccacgcttcttgattaccgcccggcataattgaaggcccgtgacgcgccccttcttcgccaccagacacacccgaaccgataaagcgaatacctttctccgccaaggctttcactcgacggttcgtatctggatagtttgagttaccgccatcaataatgatgtcgccctcttctaaatgtggtaataatgcttcaatgaattgatccaccacatcaccagcgcgcaccattaacatcactttacgtggtttttctaatttagcagctaaatcttctaaagagtatgcgccgataatattggtgccttttgccgcaccttgtaaaaactcatccacttttgaagtggtacggttatatgccacgactttaaacccgtggtcgttcatatttaaaatgaggttttgccccattacggctaagccgataacaccgatgtcgccttttactgacattgttttctcctgttggattactaaatctttgtttatgatggggctaatataattagcccctacatgttttgtctatgatgtagataaattgtaggagggaattacattcgcccttttaatctacatataattaatcttgttcccataaaataggattattttgaatatattcataaatctgtatactgaatctttgtttatggtgggggctaatataattagcccctacatgtttgtctatgatgtagataaattgtaggagggaattacattcgcccttttaatctacatataattgatcttgttcccataaaataggattattttgaatatattcataaatctgtatactgaatctttgtttatgatgagggctaatataattagcccctacatgtttgtctatgatatagataaattgtaggagggaattacattcgcccttttaatctacatataattgatcttgttcccataaaataggattattttgaatatattcataaatctgcaaataggatttttcatcacgaataatatgttcataataatttcgctgccaaacatcaaaaatttcactattttttcttgcccaagatgttacacctgctttaaatctacgaactattgagccaattgtttgagatgttcccttttgtggcaactgtgttgctctcaattgtaggggcaaattacatttgccctttacctgttcaataatttcaataataccgtgtaaatgatttggcataataacaaattcatcaattcgtacttgtggaaagaacattggaatattttcccaacactgttttacgtaattccctaaatcatttaattgcatttgttgattaatgatatgcccaaatagacattctttatttttacaacaaatggtgatgaaataaaatccttcagaacgataattataatgttttaaacgaatcgatcttcgatgatgaatacctgcattatatttcgtagtcatacattccgctgtaattgtttttatagggcaaatgtaattttcccctacaagcgatcaattttatgcaaccatttgcaaaactattgccaacactgcaggcaacccctactttaccaatatccccttattcttcgtcgtaactgccccaaaaactgcggcgataatcacacaacctaaaaagaaataaatcaccgaaatttggttgatggcataaccaaaaataatccctgctaccaaaaagccgttgtataacccttgattggcgaacaccacttttgctttcaatggtgaacatttctaaatagagaatgtagaaatgttcaagggtgacaagtgcagttaaaatataggctaaaatttccattagagcagccttaccgctgctttgtctaagtaccactccgtcaccccattttttgctttaattttggcagcagggtaaggcagattttctgcaggagtcgtttggatttcttttaaaatatccgctttgctttcacccgttaccaaataggtaatgcgtttggcttgttcaatgagtttggctgttttagaaatgcgaatttgaccactttcaggatgcttagcaatgacagctaggttttcatcatcaaaattagtttgatgtgggaagagagaggcggtatgaccatcaatccccatgcctaaaataatccaatcaaaaacaccgtttggaatgaccgcacttaattcttcttcgaagcgttttagctcaaagtgcggttcattttcgccacgaattcgatggatgttttctgctggaatttgaatatgatcgaataaaagtttttgcacttcgccatagttactttcaggatcagatggcggaaccatacgatcatcaccccaccaaaaatgcagatttttccagttaatttgttccgcataaggtgatttggctagggttttaaataataacttaggcgtcgaaccaccagaaagggaaatatgtacgggaatgatttaattgactataaatcacaaattcttgtgcaattttatcgactgcatgttgagcagttgggaagctgatatagttcattgattttccgtagggtgggctttagcccacaatttattatgttagtaagagcgnggctaaagcccaccctacattagattagttaaacttttttcttcatcaatccacttggtttacgccacactttgccttgttttgcgattaatttatcagctgcaacaggcccccaagtgccagcttcatattcgtgaatacgaccaccattggctttgtaatctaaaatcggttgcacaaatttccatgcggcatgcacagcatcagtacgagcaaacaaggttgcatcgcctttcatcgcatccaacaataaacgttcataagcggttaatacttgcgcacctgctaaatctgcataacggaaatccattgatacttctttcgcctcaaaacctgcacctggttttttcaaaccaaaacgcattgaaatcgcttcatcaggttgaatacgaataattaatttattctctggtgcattttggctgaatacaggatgtggcgtagttttaaaatggatcacaatttcagtcacacgagctggtaagcgtttacccgtacgaacatagaacggcacaccagcccaacgccagttttcaatttcacaacgtaatgcgatgtaggtttcagtacgagaatttgccggtacgcctttttcttctagatagcctttttccattttgccgttaatttcagccgctgtgtattgacccaaaacaaggttattctccatatcctccgaagttaatggacgcaaactatgcatcacttttgctacttcatcacgcattgaattcgcgttaataatcgctggcggctccattgccaccatcgctaacacttgcaataaatggttttggaacatatctcgcattgcgccagaaccatcataatagcccccgcgctcttccacgccaatagattctgcaccagtaatttctacataatcaatgaaattacggttccaaagcggttcaaaccaaccatttgaaaaacgtaatacgagcaagttttgaacggtttctttacctaaataatgatcgatacgataaatttggtgttcttcaaagaaacggtggatttgtacgtctaatgtttgcgctgttttttcatcgtaaccaaaaggtttttcaacgataatacgtttccagccatattcttccgtatttaaaccatgtgcagccaaacactcaggaatcacgccataaagacttggtggagtggacatatagtaaaaggtgttaccacaggtttgatatttatcgtgaagatcgtctaagcgtggaacaagtttgccgtaatcttgagcatccgaagtattcactgcttggtaataaagatgagagcagaaagcatctaaggtttctggtgttgtttcttcattatgaattaacgcctcacgcattttttcgcggaaagtttcatcgttcaagtcagaacgtgcaacaccaagaacggaaaagttttcactcaaacgcccgattttgtagagattataaagggctggaatgagtttacgatgagttaagtcaccagacgcgccaaaaatgacgatacaattattatcagtttgcataattattccttattcggcttccgagtaatgtcgaaaataatgccgtattctagagaaaaaaaccaatcgaaccaatcaattaaattgaaagatagaacgccaatcgaacgattgatcgcccaccataacaaaatgcggattaatcaatgtttcgcgttggttataggttaaaggctcaaaatgagagtcaaaaatggcaccgtgagtttcacctagtagcacttcagcgccagcggtatcccattcgcctgtttgtcctaaacgaacataacaatctaccgcaccttcagccactaaaccgctttttaagctacttgaaccaaccacaacaaattcacaaggaaaatccttcggcaaaatcgaccgcactttttcttgtgaagtggttgcacctaccgcaattcgtaaagggcggtcaaaatttgtcgtgtttttagtgagtttttttacctgatccagttgttttttaaacgtgccgaaatcacacattgcataataagttgtcgataaaattggcgcatgaataacgcttaacacgggtttatttttacgaactaaggttatcaacacagaaaattgatcggtacgattaataaattgttgtgtgccatcaagaggatcaatcaaccaatattctttccaatttttacgttcttcaaaggaaatatgacaattttcttctgaaagaacagggacattagggaaaagtgcggtcaatttttctgtcaaaaattggctcacaaaaagatccgcttccgtcacaggcgtgttgtcttctttcaattcaacatgaacctgtttttgataaaactgttgcaaatgcttacctgattggtaagcaatcagcaatacttggttaagtaaatgttcgttagcgtcagcataaaattattctcttgtttttggcagcaaccacggcattacaaatagagcataaaataccattccgcatgtgcttataacccgagggacaatcccccttcggtcaaccagccccaaaaggaagtgtcttgttcgccgagtaataacaaataaaaataagatgccatattgcagtaaacaaatgaaatgatcgatgaaactaatacaatcgaagcaatgttataacgtgtgtaacggaattttgcggctaaaagtgcggttaaaaatgcgggaatggcggcaagaagaaatgctgtgagagcatagctagaaaaaggaacgataacgccacttgagtcatcatcgaaccaaatcaaaagtgcggtgacgactatctgtaaaatcagagggaaaaaaataagtgtttttaagtaagatttcatagtgaaaaataggctatccagaagataacctattctaaaataaatttaaggattaatcagatttttttcgcacgtaatacgcgagatgcaaaaatcacaatgcccacgataaatacgattaaaccgaaccactcgccaattgtatcccagttttcaagatttaaggataatggcgcttcagaaccaccagtggtaacagaagccgcaataatgaatgctaaaatgacacccattaaactttcgcctacaattaaacctgcagagaaaagcgtaccgaaacgttctgctttagctgacacttctttgttaccaagttttgcaatatggcgagccataatccacgctaggaatgcaccaacaatcacaggcgtattaattgatggtggtaagtaaataccaatccccacagcaataactggcaagctaaagactttgttgctgacttttttcaaaaatgcatcaatcgtaattaacacagcacctaaacccacaccagttaagatgtaagtccattccaatttatttgtgaaaataccttgagaaatggcggtcattaacgttgcttgtggtgcagataaggcttgtgaaggatccatatctggacgtggcaatgcaccactgaaaccatacgcgtgatataagatttctaacactggcgcgataacaagtgcaccgacaaagcagccgataattaatgcaacttgttgtcgccaaggtgttgcttcaactaataaacccgtttttaaatcttgtagattatcattagaaatacaggctgtagtgattacgatagatgccgtaaacaatgtaagtgcggttaaaaatttctgaccatctacagtttcaaataagcccgaggcattaccgattgacaccaatactaatgaaatcacgataacagaaataattccgataccagaaattgggcttgaagatgaacccactaaaccagccatataaccagaagccgctgccacaaagaagccgataaataccgctaagaaagtacaaactaccactaataaaatggaaagctcaggcgaaattggtgccgccgcaataaagtgatgtaatgaaataacaattaacgcaaccgtcgcaattaagatataaatcattgtttttggagaaaggtcaatatcaatacgatgttctgatgcctcttgcccacctttcagcatacggaaagaatgaaccattccttcaatcattggtttcattaaaatcagcaatgtccaaatcgcagcaatgccaattgtacccacaccaatataacgcactttggttttccaaacagtcatcgcagaatcattaaacttgcatccgcggcaatatcttctgacattgtgaaatatggcactgccacaccccaagtcaaaataacaccgatcaacattgcgataccgcccacgataccaattaaataaccagcaccgagtaaggcaagtgaaaagcccattggtaattggaacgccgcttttcctgtttgaatccaagcacttgcaccatcagccatcacgcgtaaaccattagttaaaaatgccactaatcctgctaaaacaccaccgtaagcaatatctttcacaccgctgtcgccatctgcatgattacctgctttcaaaatttctgcagcggctaccccttcaggataaggtaaattactatttaccaccattgcacggcgtaatggaatagtgaataacacgcccaatgtaccaccagctgcacaaatcaacatcgtttgccagaatgggaaatcttgccagtagcccatcattaataaaccaggcaagacgaagatcacagaagaaagcgtacctgctgaagatgcttgagtttgcaccatattattttcaagaatgctagaatctttgaaaaatttgagtactgccatagaaatgacggccgctggaatagatgacgcaaatgtcacccccacttttagaccgagatacacattggatgcagtgaaaattaccgtaatcaatgcaccgaggataattcctcaaacggtcaattcttttaagttttcgttatacataaattgttccttgagcttaaaaaaagaaaaccgcgcaaccttgtcaaaaatttgactatttttcaagtttttttaacataaaatttgttttattgaaaaatgtttaaattaacctgtttttatttttttttcatttaataaaaatcctattaaagaataaaatttttaataacagttcattagcatactttgtggtactattttgtcgaatcaaaataaggagaaaataatggcagaaaaagaagtcagattagataaatggttgtgggctgcccgattttacaaaacacggagcattgctaaagcgatgattgaaagtggtaaagtgcattacaacaatcaacgtgcgaaagtaagtaaaattgtggaagtgggcgcaatgttaaaacttcgccagggaaacgaagaaaaagaaataaaaattatcgccttaagcgatcaacgccgaggtgcgccagaagcacaattactctatcaagaaaccgaaagtagcgtgaaaaaaagagaagaaatcgcatgggcaagaaaaaataattccctttcaatgccccatcctgatcgtcgcccaaataaaaaagagcggagagatttattgaaatttaaacaccaagataaatttgaataaaaatttcaccgcactttctatgttcttaaggtttaatatctcgcaaaattggattttgcattgaaatcaaggtttcagtggattgaatttcatcaattaactgaatcttggtcgccaaaacggaatgtaattctgcaattgtgtgtgtcatcacttttaagaaaatcgaataattgcccgttgtataataggcctcgactacttcatcaaaactttctagctttttgatcactttttcataatcttttgcactttttagaataatgccgataaaacaacatacatcatagcctaatttacgttcatcaataattacttttgtgcctttaataatgcccgattgacgcattttttcgacccgaacgtgaatcgttcctggactaacaccaaaatttttagccatttctgcgtatggtgttctcgcatctttagtgagtacacgtaatattttttgatctaaactatcaatgttgtgcataaaacttcctcctttagattttatttaattttttcacaatgaattagatgatattcaaccaagaaaagaaagtaaataaaatacttgaaataaaatcattatttactgaataatactcaaaaatattactcctcgttaaaaaaggttatcaaaatgaaaaagacatttattttacaacaacaagaaatcagctttgtgaagaacacttttacccaaaatcttattgagcaacttggcattattgaagtgcaaggcccaattttgagccaagtgggtaacggaatgcaagataacttatcaggcattgaaaaagccgtacaggttaatgtgaaatgtattccaaatgccgtatttgaagttgtgcattctcttgcgaaatggaaacgccatacattagctcgtttcaactttaaagaagacgaaggcttgtttgttcatatgaaagcattgcgtcccgatgaagattctcttgatccaacgcactctgtttatgtagatcaatgggactgggaaaaagtgattcctgaaggtcgtcgtaattttgcatacttaaaagaaacggtaaattctatttatcgtgctattcgtttaacagaattagccgtagaagcacgttttgatattccttccattcttccaaaacagattacctttgtgcatagcgaagatttagtaaaacgctatccagatttaagcagtaaagagcgtgaaaacgcaatttgtaaagaatacggtgcagtattcttaatcgggattggcggcaaactttcagatggcaaacctcatgatggtcgtgcacctgactatgatgactggacaacagaatctgaaaatggctacaaaggcttaaatggcgacattttggtatggaacgaccaattaggcaaagcctttgaactttcctcaatgggtatccgcgtagatgaaagtgcattacgcttacaagttggcttaacaggcgatgaagaccatttaaaaatggattggcaccaagatttattaaacgggaaattgccattaactatcggcggtggtatcggtcaatctcgcttagcgatgcttttacttcgtaaaaaacatatcggtgaagtgcaatcaagcgtatggccaaaagaaatgttagaagaattttcaaacattctttaaaatcaattaagtagataacaaaagtgcggtaaaaattaaccgcactttttattagatggaaaacttaaagaatacttaatagctgggcaaaatcatcaaacacccaatctggattggattcacggatagggatattgtaattgtagccgtaagttaaaccaacaactgcacagcccgcagcgtgacctgcgataatatcatttttagaatcgcccacgaaaagcacttggcgtggttcaaaaccaaattttccgcataaataataaagtggagctggatgtggcttaatggcaggtaaggattgaccgcccaacatttcactaaataaatggtcaatgccaaatgcggccaatactggctgaacatgtcttgtgggtttattggtaacaactgctaggacatagcctttttctttcaggatttctaaagtttcttttacatttggatacaagcggctgacattacataaattctcgccataataaaaattaaaacgttctgttacttgcttaacctctgtttcagttagcacttttcctgtttgttttttcgcccaatctaacgctcgagcaattaatacaggtgcaccattgccgatccaagttaaaactaattcttctggcgcttgcggtaaattaaattcagccaaggcagaatttacggataacgctaaatcaggcaggctatttaccaaggtgccatctaaatcaaagccaataagtttaaattgtgtgttcattgtttttctctgttctattacgatcgtgttttattaaaataacagttatgcgctaacacttgctaactgtgtacgtatttggtcaataacttgtttataatctggcttaccaaaaattgcagaacctgccacgaacatatctgcacccgccgcggcaatttctgcgatgttatcaaccttcacgccaccatctacttcaagacgaatgtcataaccactttcatcaatgatcttacgagcctgttgtaatttcttcaatgttgctggaataaaagattgtccgccaaatccaggattcactgacattaataaaaccacatccactttatccaaaacataatctaaatagctcaacggcatcgcaggattaaaaactaatccagatttacaaccacaatcgcgaataagctgcaaagagcggtcaatatgttcgctagattctgggtgaaaagtgatgtagttcgcacccgctttagcaaaatcgggaataatgcgatcgacgggttttaccattaaatgcacatctatcggtgcggtaatgccataatcacgtaaagcctgacataccgcaggcccaaaagtgagattaggtacataatgattatccataacatcaaaatgaataacatccgcgcctgcattaagtacgttttgtacgtcatcgccaagacgtgcaagatcggcagaaagaattgatggggcgataagataaggtttcataaaggttctccgttgagaaaatgagtgcatttagtttactcacttaacgtcaaaaaaccaacagtaatccttatatgaaataacaagataaacaaagaaagggctctttggtgccctttcagtcatgaatataaatagacgaaaatttacacgtccaaatttgctcttaacgcattcagctcaatgaactcacgacgtggctcaacttcatctcccattaaggtagtgaataattgatctgctgcaacagcatctttaatagaaactttcaacatacgacgtgaatttggatccattgtggtttcccaaagttgatctgcattcatttccccaagccctttataacgttgtacttcaagacctttacgagantctttcactaaccattcaacggcttgttcaaaactacgcactggttgtactttttcgccacgaataacataagcaccctcttctaataaaccattgagttgtttattaagagaaacaatttttgcgtattcattgccgtgaacaaaatcaaaattcaagaaataatcggtatcaataccgtgtttgcgaacagtaatcaccgcttcatacacttggcgttccgcattaaattgtgtacgcactgaatattgatgtgcttcagtttcttttgcagtcagttgttcaacaaaagatttaccccaattttccaccgcactttcctctttcatcatttcaatagaaattggcgactgataaattaatccttgcaatacaggggctgggtaatgacggtttaaacgaccgataagtttttgtacgctgttatattctgccaccaatttctcaaatacaagggcattcattgctggtgcatttgtgctgatatgtaattctgcgccatctaacgcaagggttaattcatattgctccatttcatccgcatctttaatgtagcgttcttgttttccttttttcactttgtaaagtggcggctgagcaatgtaaacataaccacgctcaatcagctcaggcatttgacgatagaagaaggttaaaagcaacgtacggatgtgagaaccatccacatcagcatcggtcataataatgatatgatgataacgtaatttatctggattatattcatcacgaccaataccgcagcctaaagcagtaattaatgtgcccacttcttgggaagacaacattttgtcgaaacgtgctttttctacgtttaagattttacctttcaatggcaaaattgcttgagttttacgatcacgaccaacttttgcagaaccacccgcggagtccccctccaccaagtaaagttcagaaagagcaggatctttttcttggcagtctgctagtttacctggtaaacctgcaatatctaatgcccctttacggcgcgtcatttcacgcgctttacgtgctgcttcacgcgcacgcgctgccataataatttgatttacaatgatttttgcatctgcaggattttccaataaatattcctgcattttttcattcatcgcagattccaccgcgcttttaacttctgaagacacgagtttgtctttcgtttgcgatgagaattttggatcaggcactttaacggaaataatcgccaccaaaccttcacgtgcatcatcgcctgaagtcgccactttttcttttttcagcatgccttcgttttccatatagctatttaagctacgggttaaagctccacgaaaaccagctaagtgagtaccgccatcacgttgaggaatgttattggtaaagcagtacacgttttcatttacaccatcattccattgcaaggcgacttctacgccgatgccatctttctcagcggtaaaataaaatggctttggatgaattgggtttttatttttgttcaaatattctacgaatgcttgaataccgccttcataatggaaatgatcttcagatccatcacgtttatcgattaaacgaatagatacgccagaattcaagaaagaaagctcacgtaagcgttttgctaagattttgtaatcaaaggttgtgatagcaaaaatatctgagcttggccagaaacgaaccgttgtccccgttgcctctgtttcgccaatcactgttaatggcgattgaggctcccctaaatgataaaactgctcgtgaacgtgaccttgacgacgaatggttaattgtaacttatcagaaagcgcattcactacagatacgcccacgccgtgtaaaccgcccgatactttataagagttatcgtcaaatttaccgcctgcgtgaagcacagtcataataacttctgctgcagaaacgccttcttcaggatgaatatccacaggaatcccgcccccatcatcttgcaccgatacagaattatcatcgtgaattgtcacgataatatcggaacaatggccagcgagggcttcatcaatggcattatccaccacttcaaataccatatggtgcaaaccagtaccgtcatcggtatcgccgatatacataccaggacgcttacgcaccgcatcaaggccttttaatactttaatgctcgatgcaccatagttatcattggtcgtttctgacataatttatctcattcttttgtaaataaaaattgggcgagattatagcaaaaaatcgccgttttggcgatgcttttcgggaaaggaaaacgataaaaaaagggcgaataatttcgccccataacttgttattttttccaattttttagtgcatcaggcaaaggcattgcctatcacattattacctcttgaattacgcgcctctcgctgcatatttccacgaggtcttgtggataaagtgcggtcagatttgctatcatttttgaccgcactttcatctaatcgcatcgtcaatgcaatgcgtttacgtggcacatccacttctaacactttgacttttacaatgttgcctgtttttaccacttgatggggatcttcccacgaatttatcgcttaatgatgaaatatgcactaaaccatcttgatgaacaccaatatccacaaatgcgccaaaattagttacattagtcactgttccttctaaaatcattccagattttaaatccgttatttcttccacgccctcagcaaatacagcggttttgaactcgccacgcggatcgcgccctggtttttctaactctttgaaaatatcttggacggtcggtaaaccaaattgctcatcaatgaattgttttgcatcaagctgacgtaccacaccggcattactcattaaatcttgaatagattgcgcggtagcttgcaaaattttttcgaccacaggataagcttctgggtgaacacctgaagcatcaagtggatttttcccgtttgcaatacgcataaagcctgcacattgctcaaaggcttttggccctaaacgtggcacttttttcaattcgctacgactttcaaaacgcccattttcatcacgatattccacaatgttttgcgctaaggttttcgtcattccagccacgcgagcgagcaatggtgcggatgccgtattcaaatccacacctactgcgtttacacagtcttccactactgcatcgagtttacgcgcaagttgggtttggtttacatcgtgctgatattgccctacaccaatggctttcggttcgattttcactaattctgccaatggatcttgtaaacgacgtgcaatagagaccgcaccacgtaaagatacatctaaattcgggaattcatttgcggcaaattcagaagctgaataaacggacgcgccacttcgcttactacaacggtttgtggtttattttctttaatttctttaatcacgtctttcgcaaaacgttcagtttcacgagaagccgtaccattaccaatggcaattaattccacgttatgtttgcggattaagctgaaaatcgccacttgagcttcagcttcacgacccgtgtgtggataaatggtggtggtatctaataatttacctgtgttatcaaccatcgcgactttaacacctgtacgtaagcctgggtccaagcccattgtgctcttcgcaccagccggtgcagccattaaaagtgcggtcagatttcgggcgaaaacatctatggcttcttcttccgctttttcacgtaaacttgccattaattccgtttctaaatgcaacgaaactttgattttccacgtccacgcaatcacttgctcacgccatttatctgctggctgtcccgtgaaacgtacatctaaataatcacgaataatttcttcacaataactttgacgacttccctcttccgcatcaggatcagcatttaaacttaattgtaaaatgccctcattacgtccacggaacatagccaatgctcggtgagaaggcacatttttcaataattcttggtggtcgaaataatcttggaattttgcaccttccgtttctttgccttcgatcacttttgatacgataaccgcatttttcgctaaataatcacggactttcgctaataagcccgcatcttcagcaaaacgttccattaaaataatgcgagcaccgtctaacgcagctttgctatcagctacgcctttttcagcatcaacaaaggaaagtgcggttgattctggatcattttttggctcattccaaagtaaattagccaatggctcaagaccggcttcaatggcaatttgccctttggtgcgacgtttaggtttgtacggtaaatataaatcctctaattcggttttgctttgtgtcgcatggattttgtcacgcaattcatcggtcaatttcccttgctcttcaatagatttcaaaatagtttgacgacgatcttctaattcacgcaaataaattaaacgggtttcaaaatgacgaagttgggtgtcatctaagccacctgtagcttctttacgataacgtgcaataaatggaatggtgttgccatcatctaataattgaatagctgcaaagatttgttggggttgaacggttaattctgccgcaataatttggctaatttgttgatttaacattgtcgtacttctttattataaaaaaacgaagatagaatactggttttagcgggatggctcaaatataattcaaaaaactttcttttatttttattatggcaaaatcaaattatattacccgtcaaggctggcttgcgcttgaccaagaactcaagtttttgtggaaagaagaacgcccaaaagtcactcaagccgtttcagatgcagctgcgctaggcgatcgtagcgaaaatgccgaatatatttatggtaaacgtcgtttacgtgaaattgatcgccgcgtgcgttttttaactaaaagattagaagtgctacaaattgtcgattacaacccaaagcaagagggaaaagttttcttcggtgcgtgggtggaattagaaaatgaagaaggcgaaaccaagcaatatcgtatcgtcggttgtgatgaatttgcccctgcgaaaaattggatatccattgattccccagttgctcgagctttaatcggaaaaacattagacgacgaagtgcgggtagaaacgccctcaggttttatcacactttatgtgaataaaatttggtatgaaaaataacttggaagaataaaagataacaaatacctaagcacaaagaaaaactaattgactagatataaaaactatcttacttgcctctttccttattcgctgcaaaatcagcaccttttgcaagcattctcaattgcaaaatcacacgtgctttaagttgctcacgttcagctttactcatatctaaagcattagcccctgcagtgaatacgattgttacgatgccttccgcttgaacataagcaacatattgcgaatattgatgtttgtaggaaatatattctgctaactcatcaacaaaatgcttaatttcgcgtgctgccgcagtacgaaaagcttgagaagtgcctgaactttcgcgtaataacaagcgaaaaacgttcgtgctattagtaataaattcaaaaaatgtatccacagaaacagaaataacactaccgcccgcatcaatgcgtttacgcgcttgacgcattaattggcgcaacatcaaacctgcttcatccaccatttctaagccaagttcatccatatcactaaaatggcgatagaaagaggtaggcgcaataccagcctcgcgcgccacttctcgtaaacttaaattagaaaaacttttttctgcgctaagttgattaaatgctgcatccactaaagcgcgacgagtcttttctttttgaacagcacgaacaccagccattatttcaacccatctagaatagatttaacttcatcgctgaccgcacttgccacacgctcataacgattacgtaatggcgaaccaggacgataaaccaacgcaatggtgcgtgatggctctggcgaataacaaggaatatatttcacacctttgcgcgtaccttcatttagtaccgctaawtcaggcataaaggtgataccagcattggctgccaccatattgcgcaaagtttcaagactagttgcttggaaatgggaattttcttttgcgccagcagtgaagcaataatctagcgcttgattacgcaaacaatgaccatcatcaagcattaacatttcttgaccatttaattggttcattggaagtttactttcttgagcccaaggatgatgctctgatacggcgagtaacattttctcgttgaaaataggtacttcaataaaagcctcagtttctggaacagtggcaacgatagcacaatctaaacgccccgtttccaattgttctaataattgatgcgtttgcgcttcataaagaaacacttctaaatcagggaatgccgcttttaacattggcacaatataagggagcaaataaggaccaaccgttggaattaaaccgatgtgtaatggcccggtcatttctttaccttgattactcgccatttctttcaataattttacttctcgaagaactgtacgagcctgatcaaccaataacatcccagattgagtaaacaacactttacggctagtacgttctaacaaaataataccgagctcatcttctaacttacgaatttgcccacttaatgttggttggctcacattacaagaatcggcagcacggcggaaatgtttatattcagataaagcaacaagatattctagatcacggatattcatgagattttccctatagaaaaattcaattaaaagaatagaattaattgattatgactatatcataattttccctataatacagcacgtaaaatttaaattaacaaccaataggagaaaaaacaatgtctagtatggaaggaaaaaaagtccctcaagtgacattccgcactcgtcagggtgataaatgggttgatgtaactacctcagagttatttgataacaaaacagtgatcgtnttctcattaccgggcgcattcactccaacttgctcatcatcacacttaccacgttacaacgaattagcgccagtattcaaaaaatacggtgtagacgatattcttgttgtatctgtaaatgatactttcgtaatgaacgcatggaaagaagatgaaaaatctgaaaacatctctttcattccagatggtaatggtgaatttaccgaaggcatgggtatgttagttggtaaagaagatttaggcttcggcaaacgttcatggcgttattctatgcttgtgaaaaacggcgtagttgaaaaaatgtttatcgaaccaaacgaaccaggcgatccgttcaaagtatccgatgctgacactatgttgaaataccttgcaccacaacaccaagtgcaagagtctatttcaatcttcacaaaacctggctgtcctttctgtgcaaaagcaaaacaacttttacacgataaaggcttaagctttgaagaaatcatattaggtcacgatgcaacaatcgtgagcgtacgtgcagtttcaggtcgtactactgttccacaagtgtttatcggtggtaaacatattggcggtagcgacgatttagaaaaatactttgcataagcaagtatttagctaattattatttgggaatgtaatttaaagggcgcattaagcgcccttttcatttgtacgaatttattgcaaaaatcaataatggggcggtggcgtttcttcagattgacttgcaatgttagacgattgaaagtcttttaatttatttgccatataacgcaattggacttgcattttatcaatatcaaattgctgttgaactaaagcgtgatttaattcatctaataactgttcctgaaatgcaattttcatttcaagttcttcgatgcgattttctaacatttgttgaatttgcataaattttctctaaattctaaaaaaaagttgagaatagatagaaagccatttaatctattcctcgtattattccattcattataaaggattaacttatatgttaaaaattcaaaaattatctattgcagcattaatggtaagtgcggtgatttctggccaagtttttgcagaagataacacattcgatgaaaaagcggcatcttatgcagtaggtacgctcatgggcagtcaaatgaaagatcttgttgattcccacaaagaagtcattaaatatgataatgcgcgtattttagatggcttaaaagatgctttagaaggcaaagtggatgttcgtaaagatgaaaaaatccaaaaaaccttagaatctattgaagcaaaattagtggctgcatcaaaagcaaaagcagaatcgattgctaaacaagcaaaagaagaaggcgataaattccgtgctgaatttgctaaagggaaagatgtaaaaacgacgcaatctggtttaatgtataaaattgaaagtgcaggtaaaggcgatacaatcaaatcaacggataccgttaaagtacattacacgggtaaattaccaaatggaaaagtatttgatagctctgtcgagcgcggacaacctgtagaattccaacttgatcaagtaattaaaggctggactgaaggtcttcaattagtgaaaaaaggcggaaaaattcaattcgttattgcacctgaattaggctatggcgaacaaggtgctggtgcatctattccaccaaattcaacattaatttttgatgtggaagtattggacgtcaatccgaaatctgaaaaataacggataagtttaatagcgcgcgttctttaacgcgtgctttttattataaaaacgagcggaatttttaccgcacttttaacctaacgctatgacattaaacgataaatatcctttcactgatgaagatcaggctatcataaattcctacaaagcagtcgttgatggtgtcagcgcactgattggcgagcactgcgaaatcgtgcttcattctctcgaaaatattgaacattctgctatttgtattgccaacggacataacactaatcggcaagttggttcgccaatcaccgatcttgccttacgttcgctccgaaatatgcaaagcgaaagtgtttcaaagccttattttacacgagcaaaaggcagcgtactgatgaaatcagttactattgccattcgtaataaaactcaacgtattattggtttgctttgtattaatatcaatttagacgtacctgtatctcaatttttgcaatgctttatgctaacggagcatacgaatgaaacatcttcagtgaactttgcgaattcagtggaagacttggttgcgcagactattgaaaaaacaatagaagaagtcaatgcggatcgtgctgttgccaataatactaaaaaccgacaaatcgtcctttctctttacgaaaaaggtatttttgatattaaagatgcgattaatttagtcgctgaacgtttagatatttcccgacatacggtttacctgtacatccgccaaatcaaacaagagcaagaataatgcgctatgttatcgccgtcaaaagccctatttacggaaagcaaggggcatttttagcttatcaatttgcagaatccttaatcaaaaaagaacacgaaatctcacagatttttttctttcaagatggagtgagtaacggaaatgcattagtgtatccagccaacgatgaagttaatttacaaaaacattggcaaatgttttctattacctacaatgttcctttacatttatgtgttgcagcatctcaaagacgaggtgttgttgataacttaactacaccaactacagctcactacaatcttgcagagggattcacaattgcaggtcttggagaatttatagcagcaagtttaaacgcagatcgagtgataaccctatgaaaatagcctttttatttcgcacatctccacatggcacatccatttcacgagaaggcttagatgcaattcttgccgcgacagctttttgtgaacccaatgatattgggatattttttatcgatgatggcgtattaaatcttatcgataaccaacaacccgaaatcattcaacaaaaagatttcattagaacctttaaattattagatttatatgatgtagaacaacgctttatctgcacagcgtctttgcagaaatttaaattagataatagagaacttatcctatcttgtgaaaaaattgaccgctctttattgctagaaaagcttaatcaagcaggaaaattgtttactttctaaggaatattatgctttatacattttctcaatcagattatcccaaaactgaactagatgattatttttcatatattacagaaaaagatgcggtagtactatggcaagacggtgtgttattggcaataaaatatcctgattattttgccaaatgtaaagggaattgcatgatattaaaacaagatattttagcaagaaatctcaccgcacttttacctcaaagcagcaagataaaattaatatcaatagaagaacttgttggaatcactgaaaattatttaccacagctatcactataaaaatcaaataatttagtaaatactcaagcaaagtatcagatatagaataaaaaaatgcggagaattttctccgcacttttctttttacttcttctgtcttttatctttaagacattcaagaattcatcaattatttgatgattttcgcaacaacgcctgcacctactgtacggccaccttcacggattgcgaaacgtaaaccttgatccatcgcaattgggtggattaagcttactgtcatcttgatgttatcgcctggcattaccatttccacgccttctggtaattcgattgtaccagtcacgtctgttgtacggaaatagaattgtggacggtaacctttgaagaatggagtatgacgaccaccttcatcttttgataatacgtacacttctgattcgaagtcagtgtgtggtgtgattgaacctggtttcgctaatacttgaccacgttcgatttcttcacgtttggtaccacgtaataatgcaccgatgttttcacctgcacgaccttcgtcaagtaatttacggaacatttcaacacccgttacagtagttttcgctgtatctttgataccgacgatttctacttcatcacctgtacggataatacctcgttctacacgacctgttactacagtaccacgacctgagattgagaacacatcttcgattggaagaaggaacggttggtcaatcgcacgttctggttctgggatgtaagtatctaagtggtttgctaactcaaggattttttcttcccattctgctacgccgtttaacgcttgtaatgctgaaccacgtacgattggtgtatcgtcacctgggaagtcatattgagatagaagttcacgaacttccatttcgactaattctaataactcttcgtcatctaccatgtcgcatttgtttaagaatacgatgatgtatggaacacctacttggcgacctaataagatgtgttcacgagtttgtggcataggaccatctgttgctgctactactaaaatagcaccatccatttgtgccgcaccagtaatcatatttttaacatagtcggcgtgtcccggacagtctacgtgtgcgtagtggcgagtcggtgtatcgtattcaacgtgtgaagtgttgatggtaataccacgcgctttttcttctggcgcgttatcaatttggtcaaatgcacgcgctgcaccaccgtagtgttttgctaatacggttgtgattgctgctgttaaagttgttttaccgtggtcaacgtggccgattgtacccacgtttacgtgcggttttgtacgttcaaatttttctttagacattgctaatgtttcctaagaagtgcggtataaaacaatcatattttacaccgctggtttacaaaaattattttttacgcgcttcaattactgcagctgccacacttgttggagcttcagcatattttaacggttccattgagtatgatgcacgaccttgagtttgtgaacgtaagtctgttgcataaccgaacatctcagaaagtggaacttctgcatagattttaacaacaaactcgttcgcttcttgaccgttaaccatagcacgacgacggcttaaatcaccaattacatcaccaacatattcaggtggagtttcaacttcaactttcataattggctcaagtaatactgggtttgcttttgagaatgctgctttaaatgctaaagacgcagcaagtttaaatgctaactcagatgaatccacatcatggtatgaaccgaagtgtaaacgtacaccaagatcaactactgggtaaccagctaatggaccagatttaagttgttcttgaatacctttatcaacggctggaatgtattcaccaggaattacaccacctttgatttcgtttacaaattcataaccagggccttctggatctaatgggtataagtcgataacaacatgaccatattgaccgcgaccaccagattgtttagcgtgtttaccttctacatcattaacacgagtacggatagtttcacggtatgatacttgtggtttaccaatattggcttccactttgaactcacgtttcatacgatcaacaatgatatctaagtgcaactcacccataccagaaataatggtttcaccagattcctcatctgtgtgaacacggaatgaagggtcttcttgtgctaaacgacctaatgctaagcccattttttcttggtcagctttagtttttggttctaccgcaacagagattactggctctgggaattccatacgctcaaggataattggtgcatcaattgcacataatgtatcaccagtagttacatcttttaatccgatagcagctgcgatgtcacctgcacgaacttctttaatttcttcacgtttattagcgtgcatctgtacgatacggccaaaacgttcacgtttttgacgtacagaattcaatactgtatctccagaattaatcactccagaatatacacggaagaatgttaagttacctacgaatgggtcagttgcaattttaaatgctaatgaagagaatggttcttcatcacttgcgtgacgctcaccttcagtttcatctggattgatacctttaatagcaggaatatcagttggtgctggtaggtattcaacaactgcatcaagcattgcttgaacacctttgtttttgaacgcagaaccacaggttaccaaaataatttcatttgctaatacacgctgacgtaatgctgacttaatttcttcttcagttaagtcttcaccacctaagtatttttccattaattcttctgacgcttcagctgccgcttcaacaaggttttgacgccattcttcacagtctgcttgcatattagcaggcacttcttcataagtgaaagtcataccttggtctgcttcattccaattgatcgctttcattttgatcaaatcaactacacctgtgaagttttcttctgcaccaacagggagttgaagaggaatagcattagcacctaagcgagtttttaattgttcaacaacacgtaagaagttagcaccagtacggtccattttatttacaaacgcaatacgcggaacttcatatttattagcttgacgccatacggtttcagattgtggttgaacaccaccaaccgcacagtaaaccattaccgcaccatcaagaacacgcatagaacgttctacttcaacagtaaagtccacgtgtcccggagtatcaataacattgatacgatgttgtgggaattgttgtgacataccagaccagaatgcagttgttgccgcagaggtaatggtgataccacgctcttgttcttgttccatccagtccatcgttgctgcaccatcgtgcacttcaccgattttgtggctaacaccagtatagaataagatacgctcagtagtagtagttttacccgcatcaatatgcgcactgataccgatattacgatatctttcaataggggttgtacgagccattattataaccttgtttatttaatatcagnttatataagggtaasgcttcatcaacgatgaagccctttaaattcaaaaacttattaccaacggtagtgagcaaatgctttgttagcttcagccatgcggtgaacgtcttcacgttttttcactgctgcacctttattatctgaagcatcagataattcgttcgcaaggcgtaaagccattgatttatcaccacgtttacgtgctgcttcaacgatccaacgcatacctaatgcgttacgacgtacagggcgcacttcaactggtacttggtaagtagaaccaccaacgcgacgagatttaacctcaacagttggacgtacattttcaagtgcaacttcaaacgcttctaaaggctctttacctgtgcgttgtgctaaagtttctaaagcaccataaacgattgattcagcaacggattttttaccgtctaccatgattacattaataaattttgcaagtaattctgaaccgaacttcggatctggaagaatcttgcgtgcttcaacactacgacgacgtggcattgcgaatttctccgtattttaatcttcaggatatccaaaacccatcagcaatatttctcattgagaaaatttgcagcgcaaagcgcttttgactggagtttatggtttaaattgttttgctaatttagacgtttggccttacttaacggagaaccattaagctttaggacgtttaacgccgtatttagaacgaccttgtttacgatctttaacgcctgcgcagtctaatgcaccgcgtactgtgtggtaacgcacacccggtaagtctttaacacgaccaccacggattaatacaacactgtgctcttgaaggttatgaccttcaccaccgatataagaagttacttcaaaaccgttagttaagcggatacgacatactttacgtaacgcagagtttggttttttaggagttgtagtatatacacgagtacatacaccacgtttctgcgggcaagcctctaatgcaggaacgttgctttttacaacctttttcacacgcggtttgcgtactagctggttgatagttgccattaaaaaagctccagtttaaatgttattcaagaatagaatgttgttcaaaaaatctacttctatatagaaatagacggcgaattctaatagttttacgctttattgtcaataattaaacaatatgctctaggattaaaactagattaaaatttaccgcacttttgtttttttataaaaaactttattccccacgttttagcattccttgttttttcaaatttaccaaaataattgaaattgctgcaggggtgatacctgaaattcggctcgcttgaccaatggaaaccggacgatgttgttccaatttcgcacgtacttcattagataaaccggaaactttactataatcaaagttagctggaatagccgtattttcatggcgtttttgtttttcgatttcttcttgttgatgctcgatatagccttgatatttaatagcaatttctacttgctcaacagcttccttatcttccattgccggtttatatggcgttaaagaagtcaaaatatcgtaggtcatttcaggacgacgcaataaatcttcaccgctagcctcacgtacaagtggactaccaagcactttattcgcttcttctaaatattccgaacgaggatgcaaccaaatgctgcgtaaacgttggcgttcctgttcaatattttccattttttgattgaaacgtgcccagcgagcctcatcaatcaaacctaattcatgggcaattggtgttaaacgaatgtctgcattgtcttcacgtagtaacaaacggtattctgcacgagaagtaaatacgcgatacggttctttggtaccaagtgtgcaaaggtcatccaccaatacgccagtataagattgatcacggcgtggataccatgcatccttctcttgaacataaagacctgcgttaatcccagccaataaaccttgtgccgctgcttcttcataaccagttgtaccgttaatttgacctgcgaaaaatagaccagaaattgatttagtttctaaggttggttttaagtcacgtggatcaaaataatcgtattcaatagcataacctggtttcacaatacgtgcgttttctaaacctttcatagaattcacaatgcccatttgcacgtcaaacggtaaactggtagagatcccgtttggatacacttcattactggttaagccttctggttctaaataaatttgatgtgaattacgatccgcgaaacgcatcactttatcttcaatggatgggcaataacgtggaccaatcccttcaatcacaccggtatacattggactgcgatccaagttattacggatcacttcatgggtttgttcattggtatgggttatataacaaggaatttgttgagggtgatcatcaacagatcccataaaagagaacacgggcaacacctcatcaccatgttgtttagctaaaatatcaaaattgatcgtacgcgcatcaatacgcggcggtgtacctgttttaaggcgatctacacgtaatccgagatctcttaatcgatgtgaaagatttacagaagcagaatctcctgcacggccaccttcataattttccaaaccaatatgaattttaccagctaagaaagtaccggccgttaagatcactgattttgcacggaaggttaatcccatttttgtgctaacgcctgtaactcgatcttgctcaatcagaatatctgtcgcttcttgttggaaaatatctaaattaggttgattttctaatgcagtacgaacagcttgacgatatagaactctgtcagattgagctcgagtagcacgcactgctgggcctttactgctatttaaagtacgaaattggatccctgctttatctgcagcatgcgccattaaaccgcccattgcatctacttcttttactaaatgacctttaccgatcccaccaattgcagggttacaagacatttgccctaaagtatctacattatgtgttaataaaagggttttaaatcccatacgagctggtgcaagtgcggcttctgtacccgcatgaccaccaccgatcacaatcacatcataagtttcagtgtaaaacatatctatctctatttattctgatcaaaaaattggcgttattctacagaaatttaaaacacctgacaaaaaaagaatggatctattgatcctttgaaagatcaggtttgtattagtaaataagatctctttttatatataaagatcttattattgttattattaagatcttttttggttgtgagtaaccttattcgatccttatggaaacaggtgttataggatccaaaaatcttgtgaaaatgcgatcattttctttaaaaatcttgtgtgtaaaatggaaagttattaacaactttattttttctcaacgttactaagtgagtaaaaacagttttatgacagattatttatgagttatccacagataaaaatgaatttttattgaaatccctataatttagttttttaaacaattaattttattaaatgtacgttttatgatttgactttgtagttactacaggttttatgcttccttcaaatcaaatagttaaggaaataaaatcaaagattttttacagtctattgttaccgaaagtgaacataatgaagaggaatgtaaagcaatagaaggattgaaaagcgaatgcaatttgtaaaaatactcaaaaatttgaccgctctttaggaagaaaaaatgccgcctaaattttaatttttagacggcattttattttcctaattattatttagataaatcaatttgatacactgcaaaacctatttcatctgtacccacttgtttcattgggtattgtgctttttctgcgataaatttcgctgcttgttcgcttggcgatgtttcaaaacggacatctaatttatcgttacctgtgataggcacaaaacgccagtttttatccgcatttggattaactgatccttctttctcactggttgctttaatataatcagccaaaatttgacggctttcatcaggcgaggcataaacaatatgtttatcaccagtacctgggaatttattgccgtaagcacgatagttattcgttgcaatcaaaaattctgcttttggatcaactggtttgccttgataagtgagattcactacacgatgcgattctgggttaattaatttacattcgccatcgtaacgagctggtttggttagatcgtattcataattgacaccatcaatcacatcaaagttataagtgcggaaaccttcccagtcgattaatgattgtggtttatcacttgtagggtcaatttgtttaaacataccagcactacattctaaccattcttttaattgttcgcctgtcgctttaacaaccactagcgtatttggatagagatataagtctgcagcgttacggaaagttaatttacctttattcacttcggtataacccgttgggtcatttttacgaccgcctgctttaaatggtgcacctgcacttaaaataggtaagccagccattgctgcaatacttggtgcaactttctctacatacgctttttgtgcttggtttacaatttgaatggttggatcatcttgtaataatgcaaggtaactatacatattgtctgtggctttgccgataggttgagaaacatatttacgtgtcgcttcgtgaactggttttaaaagtgcggtaatttctgggtcattttttgcaagtgcttttttggtttctatatcataaattggacgaagtacagctttgccagaagtcacgatccatttacccttgtgttctgttaagcctaaatccaccacgctgatattatttgcccagtaaccagccatactttctggtatgccttttacggtaccatttacgatgtccgcatttggtgatttcgcaaattctttatttgggaataaacggtgtgagtgaccaaaaataaccgcatcaatatgtggaacatccgctaaatagaatgcagagttttcagcaccttcttgataaggttcatcagatgggcctgtgtgagctaatgcaacgacaatatcagccccttttttcttcatttcaggtacatatttttgtgctgtttttacaatatcacgggtttccactttgccttgaaggtttgctttatcccaaaccataatttgcggtggcacaaaaccgatgtaaccaatttttaatttatgtgttttaccttgattatcaacaactgatttttcttgaatgacataaggtgtgaaataaggttcttctgtccccgcttttactacgtttgaattcacaattgggaatttagcttgtttgatggcatctgcaagataattgagaccatagttaaattcgtggttacctaatgtacccacttcataattcatcgcatttaaacaatcgatcgcagggttagatttaccctctttatagccttgtgcggcttgatagtctgcaattggattaccttgaattaaatccccattatctaccaatacgctattttttacttcagcacgtgcttgacgaataaggcttgccgcacgagtaaaaccgaatttatcggttggtgcatctttataatagtcaaaatcggtcaagaaactatgaacatctgttgttgccacaatgcgtaaatcaacatcgctctttccttttgccatcgcaaaacggtttgcacttaatgcaagaatactggtcgcactaatttgaataaaatgacgtctgttcatcatagagttttccttattagggtgagtaaatattccctttattctaagaaaaatagcggattcttaaaagaaaggagtaaaaatatttttatttaattaagataataatttctgtactaaggaagtataaatattaaccccagtaagtaattgattttcatcaaaatcaaattcagcttcgtgatgacctgctgtgcgatctgcgccaagaatgaagtaaattgctttgcctccatgttcttgtacacgtctacctaagatagtcgcatcttcacttgcattgaaagcataatctgaatttacgttatttatttgtggttgttcaagggatatttcttcgatgagttttataagttcaacatcgttattcatatccacggcttcacctacaatttcagtttcatatgcgacattaaaacttatggagatacctttggctatttgcatgacttgttcagtcatgtattcattaattgctttattttctccccgcacttctaattgtaattcagcagaggatggaatgacatttcgtccttcacccgcttttagcacacccacattaattcttgtcatgcctttaccatggcgtgcaataccatgaagttgagtgactgtatgcgctgcagctaataaagcattacgacctaaatggggcgcagcacctgcgtgcgcaggtttacctttatagcgaatatcaatttttgtagtggaaagaaaatttcttggattagcaataactgtgcctgtattcgcgcaaaaactaatgtgtgaagaagcaaaataatctgcatcatcaattatgccactttgtgcaatggctgctgcacctcgaacaccttcttctgctggttggaatacaatttttacttttccagtgagtttatctttgttctgagcgatccataatgcaacacctaaacctattgtaatatgtgaatcatgtccacaagcatgcataaaaccatcgttaattgaggcaaaaccttctttatttggaatatgctctggtgagcgagtttccgttacattcacacagtcgatatcaaaacgtaacgcgatggtttttcctggtttacctgaatcaaataatgccacacaaccagtgtatccttccattttttctagccatttttcattggctccataggcttttgcattagctaaacctttatctactacggcttgttttcgtccacgaacaaagtctggatttataatttgtttgccaagaaaaatttcaaaacaatctaagtcttccaagtaatccgcaatgcgagaagttgtccaaaattcactccagccaatttctggaaaacgatgaaattcacgatgccatttaacaagttgatttaaatctaagttcatttttttcttcctttaaaaggctataaaaacagaccgcacttaaataaagtgcggtcaattttttactatttttacaacataaataatgctaagaataaaacagcaagtatcatgcctggcgcggtacgttttaccatttctactgggcttaccatcgcaaggcctgcacaaacaatggttacacctgcaattggtgaagctgtacgaccaattgcaccagcaatggctgctgccataccaagatttacatgagtgtaaccgagttctacagcatgtggtgtgacggcagtnttaaaggcaatcgctgctgcatcgccagaacctgtaattaagcccattaagaatggtccaattgttgcaccccaacgtacaaattcgttggattcttttaagaaagaaattgcagcatccactgcacctgtagattttaatcctgccacaaatacactggctgcaatgataataccaagtacgtttgcataagaatttcccataccattgaaaaattcttctgtgatttttactggggaaatacgagtgacgataatgccgtaaattgcaccaattagcatcgcttgaggcacacccattttagtccattcaagacctggcacttgttgtaatgatgttccaccaatcactaaaataactaatggtattaatggtgcaagggcataaagtacattgacgccttcaataactttaatttcactttctttttgttctgcaagataagcttggcgatgttgttcaccataatctttaaaaacaagcgcaagaattgttaaaacaaccgcacctattgctcccgcaatcatgttatatggtgcatgtgaaaggtttacttgagtgatagttaagcctgacatttcactaatcattgctgagtgagaagaacctgggctcatcattgatccaaaagttcctgctaaaatagctgcccagcagtagctggtcgaacacccgcactttttaaaacgggaattaatgttgcgccaaccgcagcagcacaaccagcagcagaaggaatagcaatattgatgaaaaaggtgatgatggttgcaatcggaattaagnagaattttaatccgcttaatggtttggtaagtaaatgcactagatgagtatcacattgagtgtatttcattacataagcaaaacccatactggaacagatagccataattaatccgccagatgtcatacttttggcaaaagcatctaatgcacccattggattcagcgttagaatggacataattaagcctacaccaatcaaaacagttcgggtttcggcttttttaatcagaaaataaattgtggcaataatgccaatcactgcaacgatggatttaaataattccattatatgttccctttaagttaataagaaaaagttgtattgatatcaaatgtgccacattccatattttcactgaagcacaaaataggattttcgcccaatacggttgcccattccattttgtatatgaagcgcagaaccttcaggtaatgcatatacaagtgcggttggattaacgagtaaaaattctgccaaacgttcttctcggctttcaccattgtggccttgcattttacctgaaataaagtgcggattaatttgatgaggaaaaagctgtaatgcttgaaatgaaggaggataagtaatcggcatatcattagttgtcataatagatgagccagctacattggccccagcactccaaccaaaataaggcgtaccgttatttactttttcacgaatgatatcaatcaaattgtgttcataaagctgttttaacaaacaaaatgtattcccgccgccaatagcgatgacatctgcttgttcaataatatctcgatgctgtttgccacgatgaacggaaacaatattcatccctaaatcagaaagtgcattttgcacagttttttcatattcatcaaaagtgcggctcaccccagcataaggtacaaaagcaattgttttaccacgataatcagccaagaaattttgtaaccaaggtatggtgtgttcaagataacctgtgttcttgtattttgagctactgagcagtaacatatttttcatatttataatcctttttaggggcatttagcaataccaatattacgcttagaaaaggttaattttcaacgaaaaattataattgtttgacgaatatcaaaaaataaaccgtatcaggagaaaactatgtcaattaatcttaatcgtgttcaaaatttaattgaaaaactggcttttatttcatcagtaccaaacgagctgactcgcttagcttttacagaggaggatgaaaaggcccataatatgattattgaattatgtaaagaatatgatttgtctattcgtcgagattcaattggaaatctttttattcgtaaggcaggtaaagaagattttttacctgcagttgcattcggatcacatattgatactgttgtgaatgctggtaaatttgatggtcctttgggatctgttgctgggttggaaattcttttgcaattgtgtgaacagaatattcagactcgttatcctttagaattgataatttttacttgtgaagaatcgagtagatttaattttgctacattgggtagtaaagttatgtgtggcatagtaaatcaagaaaaattaagttcattacgtgataaacaaggaaagggtttatcagaagctatggctgaagtaggaatgaattttaatttggttaatcaagcaaaacgtgatgcaaaggaatttaaatgtttttttgaacttcatatagaacaaggccctcgtttagagaatgaaggaaaaacaataggtgttgtgacaggtattgctgccccgattcgtgcaattgttaaaattaaaggacaagcggatcattcaggagcaacagcaatgcattatcgtcatgatgcattgttaggaggatctgagttatcacttgctattgagcgagctgctattcaagctggacattctacagtagctacagtaggtaatattacagctaaaccaggagtaatgaatgttgtgccaggatattgcgaattattagtagatattcgaggtacacatgtacaagctagagattctgtatttgaattattacaagaggaaattagtaaagtttcagaaaaaagaggattattaattgagttacaacttatttcaaaagataatccaataatattacctgaaaatatggtaaaccaaatagctgaaacagcacattcccttggttattcttacgaaataatgccaagtggtgcaggacatgatgcaatgcatatggcaacactttgcccaacaggtatgatttttattccatctcatttgggaattagtcataaccctcttgaatttactgattggaaagatatagaggcaggaattaaagttttacaaaaagttatattggagcaggctgaagtttgttaattgttataaaaactcgtataaataatacgagttttttataaaggcaattccgttgtcgattttactgtttttaatatgatttctgattttaatgttttgatgccgattgcatttgtaaggtgggtattttttatatgattaagctcttcaatatcagagacacagagcttaagtaagaagtcgtaactgccagccataaatcgatagtgccgttgtgatgagctatgatgcagaaacgggcattgctaaagtaaaatgtcaatcacaaagcacctgtggggcttgttcggctagagaaacctgtggaacagagtctctttctgaacttaacggaaagcgaggcgagcatatcttcacgctcgaaaccattacgccactgcgcacagaccaaatggtagaaatcggtctagaagaaaaatccatgcttttctccgcattgttaatgtatatagtgcagcttttcacgctattagttgcaacattgctttctagctatatcagtgaaaatgaactcatccgtgcgattttaatctttatgttgaccgcactttcctttgtgatggttaagcgttacacccgaaaactcggccaacaaacagaatttcagtctgttttgttaagagtattgttctaaataaaaagagcggttgaaaacaattaaattttcaaccgctcttttgtacttagcttattactactcgaaagagcctacattaagatgtaggcgtttcttttttattttttaagatcaaatttgtaagaaacaaagccatacaatgtccaaccaataaaggtcacaattgaaccatataacatcgcttgttcaccggctgcataaagtgcatagatactatagagtgaaccaataaaggcaacaaaaacggttgttttatatttttgtggcgcaacattttccgctttcaataacactgcgagagcagccattgagagcaaatatgggatgacgtttgtaaccactgctaagtccaccaacacattgaattgtttatttaatgatgggctgattgtcattaaagagagtaaagtctgtaacgcagtaatggtaatcataccaacaacaggtgcatctttactggtaatttttttgaaaaatgctgggaaataaccttcttctgctgaagatttgaatacttgagcaatagtgaactgccagcctaataatgaaccaaagcaagacattaccattaagcccatgataactttaccgacagtttcatcaaacatatgagcaaaggctaaaccgaatggcgctgttgaatttgcgagttcaaggttaggtacaatacctgcaatcacgttagttgaaacgatataaattaccgcagctcctaaggtaccaccaagtactgcgattggtacgtttttctctggattttcaacggcatctgcgttagcacaagctgattctaaccctaagaacgcccataatgtcattgaaatagatacaccgatcgcttcaaaagttggtacattgtgcgggttccaagagtttacatacattgaaccatcaaaccatttccaaccaatgatagaaatacctaccacaggaataattacgccccaaatggtaaatgaactgatattaccggtgattcttgcaccaccaaagttaagaacggttgcaagccaaagggtgaagatagtccataatgcgatagaaagtggtgaaaggattgtgccgaaaagctctgaaccataacccaccgcagaaattgcgattgctgtattggcaataactaatgatacaccgtaagtgtagtttgccatgaagttaccggctttaccgaaagagtattccgcataaccgcccataccaccagattttttgctaaacattccacattgggcaaatgcatatgctaatgcagttgagccaaccgctgtgaccagccaagacactattgaaatggttccaatttcggctaatttggtcggtaacataatgataccagaacccatcatattaaccatggtaagaatggtgagttgtaccacaccaattttattgcttttagcactcataatttatactcctacaagtgcggtcaaaaaatcagatatttttaaccgcacttttttgtttgtgttgagagagttatgaagaagatcctcacaacctcactttattaatagtcagttaaaacatagccatatgcacgagtacgtccatcagggtctttttgtaagtaaaccccttggatttcaggtgcgaaaccaggtaatgtgttgatcccttcttctaacgcaaggaaatattggtgtgctgtagtgctccatttttctcctggcactacacataacacacctggagggtaaggtaacgcaccttccgcagccacacgaccaacaatatcagtcaacggaacgagttcaactttgttacgtattaactcaatatttgcatcatgtggatttaatacatattctggtaatgtcgctttgcggaacaaatctttttgaagttgttttacatttcggcttacataaagatcatgcatttcttggcataattgacgaatggtgtaacctttgtaacgatcttcattgtttttatacacagttggtaagacatattttaataaagagtcttgtttaatgtgtttttcaaacaaggcgatttgagcaactaaagtttgcattttggtgatggtttctgctggagtgagcaagaataagattgagttcaagtcacatttttccggaataataccgttttcacgtaagtagttagcaagaatggttgctggtacaccaaattcttcatattcacctgtttctaagctaatacccggtgtggtaagcaagaatttacatggatcaacgaagtattgttcatcagcataaccttcaaatttatgccatgtatctgttgggtggaatttgaagaactcgagattagttgcgatttcctctgtgtcataatcttgccattttttacctttaattgtggttggaataaatggacgaattaattcacagtggtttaacactaatttacgcgcttcgatacctactttcacacattcatgccataatcgacgaccagcttcactaccttgaattttcgcattcacatctaacgtagcaaataacggatagaacggactagttgacgcatgtaacataaaggcattattgaaacgtttgtgatttacataacgatcttgacctttaatgtgtttatcttttttgtgaatttgtgaagtttgtgagaaacctgcttgttgtttatgaacagattgtgtcactaaaatacctgggtcattttcatttaattcaagcaataatggcgagcagtctttcatcattggaatgaattgttcataacctacccatgcagagtcgaataagatgtaatcacaaaggtgacctattttatccactacttggcgtgcgttataaattgtaccgtcataagtacctaattgaatcactgccaaacggaatggacgtttttggtttaatttttcaggtgcaacttctttaattaatgatttcagataatcttcttcgaagcagtgactatcaataccaccaatgaaaccaaatgggttacgtgcagtttctaagtaaattggggtagcacccgcttgaattaatgcaccatggtggtttgatttatggttattacgatcaaataacactaaatcgccaggagcaagtacagcatttaacgcaactttgtttgaagaagatgtaccattcaatacgaagtaagttttatctgcattgaatacttgagccgcatatttttgtgcatcacaagctgccccttcgtgaattaacaagtcacctaatttcacgtccgcattacaaatgtccgaacggaaaatgttttcaccgtagaagtcataaaggaaacgaccagctggatgtttacgatagtattgaccaccttgatgtcccggacagtcgaaagcgatattacccatttccacatattcacttaacattttgaagaatggcggtaacattttttcttcataaagttttgctgcagtttcgatttggcggctataaagtttgatgtcataaccgtttaaatcttggatatggtaaatagaatcatagaattttggatccacctgttgttcgtcggtttgaacaataaacactggaacatcaaatttcgttgctttaattctatcgaggtattcacctacatcacttgaacttaatacgatagctgcaacatctgtaaagtctgttttagcaatctcaactaattctctatttgtagagaaatattgttcaacttttggactatatgcaatttttaaatttggcataataaactcctttatttatttttgacgtaaagttacccagcattattaattttaataacgcaatagatttatttagaataaaataacacgatctagttttttattataaaaactaaagtaagaatatatttattttaaattaaataagatcaagttaatttcataaaacatttcttacctgttctaggcaatacaaaaatatccagaaattaatctatggagactctctaaacagagagaacaactctgtttagagagccctgttggatggtttgttttgagaagcaaataaagagtatgagaaacaagaacgataggatggcatcataatatgacgagtgcgacgaatatgagccattaaagaacgacctttaataggattaaaccgnaaaaatcttaatgcctttgtatggacatatctgtgtatatatgtacgaaatagcataggaaaaatccctctttctatctaaagtaacctctcttgggtatattctcaagcacatttaaggatcatgtcaataatattttttaaaaaatgtgatcttagtcaaaaacaattttaaattttacataaaaaatacaaaaccaaaacaaaaaaataataaagttattaaatttttagaattagaaataaagctattttatataaatcttaaaccaaacttgctaccattaccgctttaattgtgtgcatacggttttctgcttgttcaaatgcaatgttcattggagattcaaatacatcttcagtagttgttaggtgggcttcagcccaccaacaaacaatcgcgagatattttgtggctgaaggcccnccctacgttaagtacgcatcattctatgcgtgcttctttttattttaggcgcaatcattatgatgattttataaaggcaattcagttgttgatttgaccgtttttagagtaacttctgattttaaggttttaatgccaagcctagaattaagataggtatttttgactaattaaacgctatataaggatacttgtactactaataaaatggaaccaattagcaataagcatccaatcattggcatgacgaatttaacccatctatcaaatggaatttgcaacatttggagtgtcactaacactaatcctgtcggcgccaagaatagcattgcatattgtccccagttgtaagcggaaaccacgatatcgcgtggaatacccactgagtcagcaagtggtgccataattggcattgaaagtacggctaaaccagaagaagatggtacgattaaacctaggaaaataaatacgactaattggcctaagatgaatacgctacccggcataccactaactacattagacatataatcaaggatagtgtcagaaatcataccttgttcgagtactaagtttacgccacgagcaagaccaatgattaaggatacgcctactaattctgatgcaccttcagtgaaagattccataatatctttttcagacaatccactaataaacataatgatgatggtaatggcaaggaaagatgcagccatttgagggaaccaccatccgccaaccattacaccccaaatcataatagggaatgagatacagaaaagcgttaagattaatttgcgacgagctgagaatgggatagttgtgttcggatcaaagtttttcatataacgttgacggaattcttcgcgatcgtcgtaagtataagaaaaacttgggtcagctttgatttttttacagtaccaataaagatatgcgattacgcaagttgcccctaaaactaaacctagagcacggaaaccaataccttcagtaaattgaataccagccgcatttgatgcgataacaacggagaatgggttaattgtagagaatgcagttcccatagatgcagcaaggaatatagcccctacgcagactatcgcatcatatcccagagccaagaatacaggcaccagaatcgggtagaatgccactgcttcttcttcgataccacaggttgtgccgcctaacaccattaagacggatacgcagaatacaataaaaaactcattgcctttagttttcttcacgagagccatcaaacctgcattaaaagaaccggttcggttaataacaccaatcataccccccaatacgaagataaagaccataacatcaacggcttcgatagttccttccaccatacttttggtgatgtcttcaatgcctttgtggtgttgttctacacgttgataggtgccaggaatagcgattggttttttgatcacgccttcggtgaagttggagagtttaattttgatattgagattatcaagagtgtctgttgtggcgggataagttttatcatcaacgccgtaagctttgacaacaaatacattatcagtggaattatatgttaattttgaatatgaaccggatggaataacccaggttaatccaacagcgagaattaatattgcaaataaaatggtaaacgctgatgggaaattaaacgttttcttctttttggatgcatccatagcgagctccttatgtttaacgtttaaagtgcggttggtaaaacattggttaaaccaaccgcactttttaccttgagaatggcttcccaaagttcctttattatttaagcataataggatatgccttcagtttttttcgtaatacgagtaccagctttgcctttcacaatgtccacaatatcagataaagatcctattactgcatcttttcctgtttgtttcgcaaagttgatcgcggcttgtactttcggccccatggaacctgaagcgaaaccaagttctgaaatagcttcaggtgaggcaactgaaattgctttttgattaggtttaccccaatctacgaaagttgcggaaacatcagttgcgatgatgaataaatcagcgtcaagattttctgcaagtaaagctgaacataaatctttgtcgataacggcttcaacaccttgtaaattatggtgttcatcataataggttggaatgccaccgccccccgcacaaattacgatactgcctttttcaagcaaccatttgaccggacgaatttcaaaaatacgttttggtaatgggcttggcacaacgcgacgatatttatcaccatcttgtgctatagaccaatttttttcttttgccaaacgttcagcttcttctttcgtataaacagggcctattggcttagttggatttttgaaagctgggtcgttgatatcaacttctacttgagataataacgttgcaaatggcacttcaaatggaactaaattaccgagttcttgttgaatcatataaccaatcattccagctgtttctgctcccaatacatctaaaggataggttggcacatcagtataggcagcaccttgtaaggcgagcaaacccacttgtgggccattaccgtgtgctatcactaattcattatttggccaaatcttagcaatttgctcacaagcaatgcgaacattttgtcgttgattttcggctgtcattggttctccgcgtcgtaataacgcattaccgcctaatgcaatcactattctcatacgttctccttatgccaaacttgctaccattaccgctttaattgtgtgcatacggttttctgcttgttcaaatgcaatgttcattggcgattcaaatacctcttcagttacttcaataccattagctaattcaggatatttttcagcaatttgacgaccaactttggtttcgctgttatggaaggctggcaagcagtgcataaatttcacttttggattaccagtgcgtttcattaattcaggtgtgacttgataaggaagtaataatttaatgcgttcgccccaagtttctaatggttcacccattgaaacccacacatcagtatggataaaatctacgcctttcaccgctttgtcgatatcttcagttacagtaatacgagctccactttctttcgcaaatttttcgcacatttccacaagatttgcttctggtaataatgctttaggtccacaaatacgaacatccatacctaattttgcaccaattaataaaagtgaattacccatgttattgcgagcatccccaatatatacatagctaatttcacttaatggtttgtcgcaatgttcaatcatggtaagtacgtcggcaagcatttgtgttgggtggaattcatcggttaaaccattgaatactggcactccagcataatcagccagttcttgaacgatactttgtttaaagccacgatattcaatgccatcatacattctgcctaatacgcgggcggtatctttcatgctttctttgtggccaatttgagaggaattagggtcgatgtaggtgacttgtgcgccttgatcataagcggcgacttcaaatgcacagcgtgtacgggtggaggttttttcaaagatgagcgcgatatttttgccttttaatttttgttgttctgtgccagcatatttggctcgtttcaaatctcgggagagatctaagagatatttaatttcacgttctgtgtgatgaacaagactaagtaaatgtctatttttcatattgaaagccataataatctccttgtgttttgactatacattggggaataaacatacatcattcgagatactgcttgttgttcgaacagttgcattataagagaggtaaaatgaaatttgttgtcgtttttcaactggtaatgccagtatgtagaattttattgcgagatttttagtattattagaatttaataaaataatctaactctttattgttatttgtttgatttctaatagtagatgaatttaaacgaaaatatgttttagtttatttttgatgaagaggaatgtgtctatctatacttaataaaagtgcggttatttttattgcagtttttaatatattgatcttcagcaagtaccatttgtatatttagtgatatgataaacatagtttattttttgaggtttttatgaatttaccttttcgagcaatggtgtctgatttagatggcacacttttaacacctgaacatttagtcggtgatcttaccattgatacgctgagagcattagagcaaaaaggcgtagatattattttggcaacaggacgcaatcataccgatgtgtcatccattcttggaaaaattggtgcggaacgtgcggttatgattacatcaaacggtgctcgtgtacgggatttacagggtaatttgctttatagcaatagtttgcctgaagaattagttcttgagctttacaaaacgccatttgatacttccaaagtatgcatgaatagctatcaagatgaaggttggtttactaataaagatattcctgcaatgcgtcagttccataaagaatctggattcgattataacgttgtcgatttttctaaacatcatggacgtgggacagaaaaagtcttttttattggtaaaacgccagaggatttagttgaagtagaaacttatttacgagataagtttggtgacgtaacgacaattgtttattcagcattagcttgtttggaagtaatgaataagaatgtttcaaaaggggatgcattaaaacatttactcgaatcacgcgagtatgagttaaaagactgtattgcttttggtgatggaatgaatgatgtagaaatgctttcttgggctggaaaaggttgcattatgaaagatgctgatattcgtttaaaaatggcttgtccagagttagaagttattggctcaaataaagaagaatcagtcgctcgttatttgcgaacccaatttggattagattattaatgcaggcattattattcataagttatggtgcaatattaggcgcgtcattgcgttgggctataggattgttatttaatcctttattttcctcatttgcttttgggactttaatcgctaatttgtttggctgtttaattattggtgtattacttgggcttttttggcaatttccacaaattagtgctgaatggcggttatttttaattacgggttttttaggatcgctaaccacattttcgtctttttcttccgaagttgtggaattattttttaatgacaagtggttaaatggattttgtgtattaatgatgcatttattcggatgtttagctatgactgtgttaggcatttggatatataaaatttgtctcaacttttatcttaatcccattcactttggttttgcccaattaaatcagcaaattcatcgctacgaaatccgtgtgatagcatatattgccaaattttttgtttcattttaggcgtttgctgttcgttataatttgggaattttttacgtaacaagttctcagccatttcataccaatcaatttctgattccattaaaacttcatcaataatatcagaagacacaccttttaattggcgtaattcttgtcgaattcttcctacaccataacctttttgcacgcgtgaatttagataattttctgaaaaacgacgatcactttgccaattttttgcttggcatcgagataatgcatcatcaatttcttcttccgaaaagttcttttcctgcattttattgcggagctcgaattcactatattctctgcgggaaagaagattaactatgtaattaaaagcaagagatgacaaggaatgattcctttatttttattgagttgatataaagtgcggtcatttttaaccgcacttttggcatttgtaattttctttattcaaaatcactttctgattcagtattattttcagattgttcaatatccgccattaaggcttgttctggattggccactaattcagcacgtaaacgagcttctaattcatctgatttctctatattttcgttaagccatttcattgaattagcctttccttgaccaattttttcaccattgtaggaataccaagcgcctgatttttctacaagtttgtgttttacaccaagttctaataattcacctgcttttgaaatgccttctccatagagaatttggaaatccacttggcggaacggtgccgctaatttgtttttcactacttttacgcgggtttcatttccaataatattttccccgtcttttacagaacctgtacggcgaatatctaagcgaacagaagaatagaattttaatgcattaccgcctgtggtggtttcaggattaccaaacatcacgcctattttcatacggatttggttaataaacacaactagacagtttgcatttttaatttgacctgtgagtttacgcaaagcttgagacattaaacgtgcttgcagccccatatgagaatcgcccatatcgccttcaatttcagcttttggtgtcagtgcggcaacggagtccacaataattacatcaattgcacctgagcgaactaatgcatcacagatttcaagtgcctgttccccattatctggttgagaaacaaaaagttcttttacatctacaccaagttttgctgcataaataggatcaagtgcgtgttctgcatcaataaatgcacaggtttttcctgctttttgcgcttgagcaatgacggaaagagttaatgttgttttacccgatgattcaggcccgaaaatttctacaattcgacccataggcaaaccaccaatccctagcgcaacatctaacccaagtgaaccagtagaaatagactctacatccaacgttttggtatcgcctaatttcataattgagcctttaccaaattgtttttcgatttgccctagtgcagccgctagggctttttgtttttcttcttgagttgccataattaaaatcctgtttgaatgttcaaatttttgtgattatatctgtattgatgtacaggtcaagaaaaatatttatattaataaaaaaatatggggtatatatttcagtaaagaggatggggaaggcttaaaataaaagntttaaatatagtatattaatatataaaccaatcgtttagataaaaataaattttaaatttacgatctggctcacaaatctgacatttatatttaggtgtagtaaaaatttcatgatataaatgaaatcagaagtacttctactgactcttttaaaataattattcattggaggtttaatatgaatataaaggatgagcatatagatagcgtttgctccttgttagatcagttagtaggaaatgtttcctttaaaaatctttttactggttacggtttgtttcacaaggaagagacaatgtttgctatttggcaaaataaaaaactttatttacgcggtgagggtgttctcgcaattcaattaactaaattaggttgtgaaccttttacaacgaatgaattgaataaacggtttgtgctttcacaatattatgcactttctgatcagattttacgtagtaatagattgtgtagaaaattgattattctttctattaagcagattcttgagcagaagctagaatgtacgttaagaaaattgaatcgattaaaggatttacccaatttaacgattaaacatgaaagagctttaataaaagttggtattacaaatgttgcgatgctaagagagattggcgcagaaaatgcattggtggaattaaagaaaagtggcagtggtgctacgcttgatttttattggaaattagtatgtgctttgcaaaataaaaatagtcagatgttaagtcaagctgaaaaagagcgtttattgaagaaattaaacgaagtttggagaaaaaatggcttaaaaggctatagaaaattagatgatgaataaaatttgttcattcaaataatttnnngcaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaactatttttaattttgaagtcttaataggtgcttaactgaaaattcattattacttttttaagtagtattttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaaacgaaaggtgtagtgtaaataaataataactaagacataaatgattagttattaaattatgatgaaatggggatatagctcagctgggagagcgcctgccttgcacgcaggaggtcagcggttcgatcccgcttatctccaccacttatcattgttaagtaaattagaaaaagacaaattaataaagtattaaggtagtgattaagctattttaaatattaggttattttattcttagttttaagtttaattttaaatttaattttgttttagtttatttaacgatgataactgaaaagttttatcaactgttctttaaaaaattggaaacaagctgaaaacaagagattttcgagagaaagtctgagtaggcaaaacagtaaagtgaaagagagaactgaaaaggaaactctaaaaacaaaacctgttttgtaaaaaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcaatatagtgaggagaatgtgttgggaagcacaatcaaagagggtgataatcccgtatctaaaaaccatattgtggtactaagctaacgagaagtagggcgggacacgtgatatcctgtttgaagaaggggggcccatcctccaaggctaaatactcctgattgaccgatagtgaaccagtactgtgaaggaaaggcgaaaagaaccccggtgaggggagtgaaatagaacctgaaaccttgtacgtacaagcagtgggagcgagggcaaccttgtgactgcgtaccttttgtataatgggtcagcgacttatattttgtagcgaggttaaccgaataggggagccgaagggaaaccgagtcttaactgggcgaatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctagggggccatcccggcttaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcagaatttattctgttgggtaggggagcgttgtgtaagcggaagaaggttcatcgagaggtgggctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtaagggctagcccctgaaggttgaaccggtcgaagataccagctggctgcaactgtttattaaaaacacagcactctgcaaacacgaaagtggacgtatagggtgtgatgcctgcccggtgctggaaggttaattgatggtgtcatcgaaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgtaggatgattgattggggctgctcctagtacgagaggaccggagtggacgcatcactggtgttccggttgtgtcgccagacgcattgccgggtagctaaatgcggaagagataagtgctgaaagcatctaagcacgaaacttgccaagagatgagtcatccctgactttaagtcagtaagggttgttgtagactacgacgtagataggttgggtgtgtaagtgatgtgagtcattgagctaaccaatactaattgcccgagaggcttaactatacaacgctcaagtgtttttgggagctaagtgaagtaagagatgaaaagcgaagcaaataaaagcagagcgaaagagaagtaaaagactaaacaaagaaaagtaaatatagaagacttaatagaaagaaaatcggattcagcttgtgaccaataagaacgagtgaaaggtagaggaaagactgagtaacgagagataaaagagacgagagataaaagagaaaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttttatttttttagtttattcattgagtaaattaaaaaaataaaaaatttttggcagagatagtgcaatagatccacctgagaccataccgaactcagaagtgaaatgttgtaacgctgatggtagtgtgggggttccccatgtgagagtaaggcactgccaatcgtcatttttagcggagtggtagttcagctggttagaatacctgcctgtcacgcagggggtcgcgggttcgagtcccgtccattccgccaattcatatcatagtttattgataccaataggggcgtagttcaattggtagagcaccggtctccaaaaccgggtgttgggagttcgagcctctccgcccctgccataaaaaacctttcattttcaataatttactacattgtaaaaattctcttgtgagaaattatcgtctgtgacatttattcataaactttattatgtgatcgcatttaaatgcgtaggaatataataatttctaataattaattttgttgtaaggaataaaaatggaagagtccctagaattagaaaaattgccacgaatcattactgatgtattgaaaatcgtgctttgtacagcgttgattgcgctagcgattgtgcttattattgtccttgtaaaaataacttatactttatctatgatggtgcttaacacttcgtctgttgtaccttatgatgttgctgaacaagcagtaatgtttttcttatatttcgggtttattggtttgattgtgcagtattttaaaagcggatatcacttccctttacgctatttatttatgctgggatcactgcgatgttgcgtttaatcattgttaatcatgaaagctcgatggataccatcttatttgcaggcgtaattttgattatggtgatcgcactctgtttggtgttatattctaataaactgagaaatatatagttttagattcaaaacaacaaaaaacgcacttcatttgaagtgcgttttgtctttttagttgagctactcagatttgctttctaaaagtgcggttgaattttcttctgttttttcttccgcactttctggaatgacatcctgaattgccatcactgatttcaaactctcttggcgaacttgttcagctaatgctttatcgcccgcttgttcaaatacataagatgccatcatcaaatcattttgttctaattgttcagggcaagcgatcacgtttttgaatacatctgctgctttaataaattcattgttacgaacatataaataacccaaagcacgattgatacagcatttttgtttttcatccacacgttttgcacgtttttctattagcttgagaagtttactgttatcttctggttgtaaacgtgtaatttgagtacaaagaggtaaactgattgctgtattgtcaccgagttttttcagtatttcaaatgtcaattcagtagctgattcatgatcattacagtcaattaaacgttgaataaggctaattttaagttcaatattgttacggcgatgacgaggttgctgattccaccaagttagtaagccatcaattccttcttcgttcattttctcgtcgagtaaaccattttcggttttagagcgaagatctttgaattcttcatcattgaataaaccgctattcgcaacattgtctaaaattttatctagagcttgataggctttagagcgaagataaatttctaccgcgagttttaatacttctttattgcgacgagccatttctaataagctatctacagaactgcgcgctgcaggtaacttgttttgttgcaataaaatgcgagtacgggcaatttccacgagcaaattatcagagccggctaattctgttgcttcaattaaatagcgatttgcactaaattcgtcgccacgttgttgagcggcttctgctgctttgatgagatttagtacaggttcagcagaatgtttagcatttttgccaattaatttttctgctttagcgtaatccccttcatccatttttaccaagccttcaagggtttgtttttgcgcttttacacgtttgcgattagaaaaccattgataagagctacgacttaaacgaaagaaacgagtgacgccccattcaaaagcataaattattgctaaagaaataatgaaaaaaatcactaaggtagtgatggacatttctataatacgatttgctgtctcaatgcgtacataaccttgctgaccagaaatataaggccctgctacaagtcctacaagcaatgtcagcattaaaaagagcactctaaacatagacttatccttattgttgtgattcagattgtgttggtttaacagcttctacttgaggcattgtatcaatcgccttgtctgcttcaatttccactttttgtacatctaaagctgtacgattaagatatttgtcaagtaatgttaaactttttaattgctctggtacatctacataaatagaagtatcagtcaatccatctactaattttaagaaattttgtgttacttcagcgtttgtatcaaaatagctacgaacccaagaagaaacagcttctagagattgcttataaagttcattttgctgacgaggaactgccataatcgcaagctgtaaacgtagacgaatgttctcacgaagataaatatcttgatttggtgcaagtaattcttttttatttgaattttgttttggcgaaatacgaataaaatgatttaggaaagaggttgcgcttttttcaatattttgttgccagtcagtaatgttgttggataatttatcattatttttagatgtttcatcaaaatttacantcaaagcctctgtaattcatcgactgtgtttgcaagctgtgatagtttttgcattatcgcattttgatccacacttgaaagcgaaagaagttgttttaaatcttgattgattgcactacgaatttcatttgcttgtgaattattaaccttgacgagggtttcatcagctaattttaataaagaaaccgctgtatcaacatcgttatctaaaacaagtttacgcagggcattatttagtaaaaaatcagcttcggaaaataaccaatcgcttggttgttgtgcgatggcaagctgacttacttgtttcatttgagtttgtaaggatgttatttcccctgttttgcttacaattaattgttccagttgagctatattttcttgtgcagtttttaaactctgttctaattgtgtaagtcgtttattgttattggtgttatttgaggaaagatttgctcccgtttgattttcaagtgcggttaatttctgttgaattttagccatttgctgctgaccaaaatagtatccagctccaccaatacctagcgcaacaagtattgctaataaactcaatgctgtaccagtttttttcacaatagtttgcggaacagactgcattgtttcagcttgttcaacagctgttttgggcgtatctgtaagttgttcggtgaggtcgttaggttgctcttttgccatatcaattccttaataagtgatattgagtaaggtattttataatactttgcgttgataagaaaaatatcaagctatccactaataatagaaaatatagatttttatatcggcagaattaagctatttacgcaataaaactaggtactatcctaccactcttaggtaaaaaagtcattttgattgttgataggtaaaatttatagtatttttcgaaaaattgtgatttatgtcacatttttttgcatttatactccctaagtggtaaattgttcgccaatttttgttgttctggtagggacaccacgtggaatgtaatctagcacaagcaaaacaatgggttagcgccttggatcaacgccgttttgagcgtgcattacaaggttcaggcgatgcattccaacacgttttagcgattgtccctttacttttacacctaaaccatccacaacttcccggctatgttattcacgccccctcaggtattgcaagtttcctcgcatctgattatcaaaaaaagtggctcaccaatgaatacggtattcattatgccgatcataaaccatcaacactcaaaagtgcggtaaattttcacgaagtttttccaccaattttaggtgtttatgtaatgggtagctttggctcaataagtcaaacctcttcttcagatcttgatacttggatttgtgtccgtgatggcttgagtctagatgaatatacacttcttactcaaaaagccaagcggattagtgaatgggctatgcaatttaatgtggaaattaatttttatttgatggatcaacaacgtttccgcaatgaacattatgctgacccactgactattgaaaatagcggctctgcgcaatatatgttattgcttgatgagttctatcgctccgccgtacgcttggcaggtaaacctctactttggttgcatttatgggtggaaaatgaaaaagactatgaaaaagaggtggcacgtttaattacggaaggggaaattgatccaaatgattgggtagatttcggcggtttaggacaattttctgcaaacgaatatttcggtgccagtttatggcatctttataaagggattgattcaccttataaatctgtgctcaaaattttgttgttggaagcctattccaaggaatacccaaacacttgcttaattgcccgcacttttaagcgagatttacttgcaggcaataccaatcctgatcaccattttgatccttacattgccattcttgcaaaagtaacccaatatttaaccgcactttctgaatttaaacgtttggattttgtgcaccgttgtttctatgtgaaagcaacggaagattttgcacgttaccaagccaataattggcgtattcgttatatggaaatccttgcgcaagaatggggatggtctgcagaaacggtaaaacatctcaataagcgtccattttggaaaattaaggcagtaaaagaaaaccacgataacataatgaaatttttaatgttgagttatcgtaatttagtggaatttgctcgaaagcatcacattcactcgagcgtcgtgccacaagatatcaacattctttctcgtaaactttatactgcttttgaagaacttcccggcaaagtgtccttactcaacacacagatatctcacaatttatcagaagcacacctgacttttgtggaagttcgcggcaataaacattttaaggatggttggtaccttatcaatcaaccaatacaccatattatgttctccaaagaacgggtgatcgaatacggagaaagcctgaataaattagtttcttgggcttatttcaatcatttactcactgaaaaaaccgaattgtcaatttttagcaagaatgtgactttaagcacattacaacgctttgtcactaacttgcgtcagtcttttccaagcaccatcgctaaacaacctaaaaacagcgatttattaaatcaatgtgaaattcgtagcttgtttattgccataaatctcacgaccgatccaacatccaaagtagaagaagtattaacgggtatttcatcgcgagatttatttagttttggatccctcgagcaaagccttgtgggcagtatcgattttacttatcgtaacgtgtggaacgaaatccgaacgctccattttgaagggcaaaatgccattttgcttgcgctaaaagtactttctaacaaaatttatcgtggtgttaatcgcccagattcaatccaagtctattgttatagtgaacgttatcgccaagatttacgtcaattagtgatgggattagtcaatcgatgcgttagcatccaagtcggcgatattcaacaaccttgccaaacgtcacgtttacgcgtagcgggtaaaaactggcaattattttttgaagatcgcgggattagcttacaagaaatcggaaatgaatcggtctgtaatgaagctgaaagtgcggtggattttgacgaagttttacaaacaccaattgaagatggcgagacaaaccaagaaagtcgtcgctatccaccagaaatggatgccttcgccagtgaaggattcctacaattcttttttgaagataattctgatcacagcttcaatgtttatattttagatgaatctaatcatctcgaaatctatcgccactgcgatggtgaaaaagatgaaaaagtgcgggagattaatcaactttatcaaaacgccaaacaggaaggcgataaaaatccttacaatatcgttcaacataattttaactaccctcaattttatcaactacaaaatggaaaaaatggcatatccatcgtgccgtttaaattccgccaaatgaataagtaatattttcctgtggttgataggttaccgaaagatatctatacttatttcctcttttactagataaattgtagatatgataacttcgcaaacaccaatcactgtgctaggtgcgggatcttatggaactgcgctggcaattaccttttctcgcaatggttctcccactcacttatgggggcacaatcccgcccatatcgcacaaatgcagacagaacgacaaaattatcgttttttgccggatgtcatctttcctgaggatcttcatttagaaagtaatcttgcacaagcaatggaatattctcaagatattttaatcgtggtgccaagccatgctttcggtgaaattcttataaaaatcaaaccgcacttaaaagcccatcaccgattaatttgggcaacaaaaggtttggaacgtaacacagggcgtttactacaaaccgtagttgaagaacaactcggaacgcaatatccactagctgtactttctggcccaacttttgcaaaagaattagcgcaaggtctaccatcagctattacgcttgctgccaataacgagcaattcgcacgggaatttcagtctcgtattcattgtagtaaaggtttccgagtttatataaattcggatatgactggcgttcaacttggtggagcaattaaaaatgtgatcgcaattggtgcgggtatttcagacggtatgggatttggcgcaaatgctcgcacagcactgattactcgaggtattgcagaaattacccgcttaggtatctcgctcggtgcaaataccaatacatttatgggaatgtctggattgggcgatttagtgctaacttgcaccgataatcaatcgcgcaatcgacgttttggattaatgctaggtaaaggattagatgcccaaatggctatggaaaatatcgggcaagtcgtagaaggtttttataatacaaaagaagcctatttgcttgcacaaagacaaggtgtggaaatgccgattacagaacaaatttatcaaatgctgttttgtggcaaaagcgcacaagatgtagcaatcagccttttggggcgagcatgtaaaggcgaataaaaggagaaattatgacattagatgtgtggcaacatattcgccaagaagccaaagaacttgctgaaaacgaacctatgcttgctagtttttttcactctacaattttaaagcatcaaaatctgggcggtgcgctaagttatttattggctaacaaattagccaatcctattatgccagctatttctctccgtgaaattattgaggaagcctatcaatctaatccttcgattattgattgcgctgcttgcgatatccaagctgtccgccaccgagatcccgctgtagaattgtggtccactccattgctttatttaaaaggtttccatgcgattcaaagttatcgaattacccattatttatggaatcaaaatcgtaaatcccttgccctttatttacaaaaccaaatttcagtagctttcgatgtagatattcacccagcggcgaaaattggccacggaattatgttcgaccatgcnacaggtattgttgtgggtgaaacatctgtaatcgaaaatgatgtttcaattttgcaaggggtaacgcttggcggtacgggaaaagaatcaggcgatcgtcatcccaaagtacgcgagggtgttatgattggggcgggtgcaaaaattctcggtaatattgaagtaggtaaatacgccaaaattggggcaaactctgttgtgcttaaccctgtgccggaatatgccacagcggctggcgtgcctgctcgtattgtgagtcaagataaagcagcaaaacctgctttcgatatgaaccaatattttatcggcattgatgatggaatgaatttaaatatataaggagacaccatgatcaacaaagatacccaactctgcatgtctttatcaggtcgtccgagtaatttcggtactacctttcacaattatttgtacgacaagctaggattaaatttcatttataaagcattcaccacgcaagatattgagcacgccatnaaaggcgntcgtgcattaggcatccgtggttgtgctgtttcaatgccattcaaagaaacttgtatgccatttttagatgaaantcatccgtcagcacaagccattgaatccgtaaacaccatcgtgaacgataatggctttttgcgtgcatataacactgattacattgccatcgtaaaattaattgaaaaatatcatttaaataaaaatgctaaagtcattgttcatggcagtggtggtatggcaaaagccgttgtggcagcctttaaaaattcaggttttgagaaattaaaaatttacgcacgcaacgtaaaaacaggtcaatatctcgccgcactttatggctacgcatacattaattctttagaaaaccnacaggcagatattttagtcaatgttacgtcaatcggcatgaaaggcggcaaggaagaaatggatttagcctttccaaaagcgttcattgataatgctagtgtcgcgtttgatgtagtggctatgcctgttgaaacgccctttattcgttatgctcaagcacgaggaaaacaaactatttctggcgcagcagtgattgtacttcaggctgtagaacaatttgaactttatacgcatcaacgcccaagcgatgaattaatcgctgaagctgcggcgtttgctcgaacaaaattttgaaataaagatatggtacattgtgttttttattaaaatttgttgctctcgatcacatttctgaatattgctcgttgcatctttataacattcatttaacattgaaccctatttaagtgatagctctaacggaggaactttatgggtgagatggcatctttaagaagtcataaaaatggcattatttttattttagatattgtgctgttttttgtgttattaaatgtattaccttttgaaccaaaagctaattctggtttggcattattagcttttatcgcggtgctttggttaagtgaagcattacacgttactattactgcattattagttccacttttggctgtggcattgggattagttagtaccaaacaagctttagttggttttgctgatccgacaatatttttattttttggtggcttttccttggcgacggcattgcatattcaaaaacttgataaattgattgccaataagattatggcactagcacgcggtaatttatttatcgcagttatttatctctttttgattacagcctttctttctatgtggatgagtaacacggcaactgctgcaatgatgttacccctcgccatgggtattttaagccagcttgatcgcgaaaaagatcataacacctatgtgtttgtgctgttagggattgcttacagtgcatcaattggtggtatgggaacccttgtaggaagcccaccaaatgcaattgtagcaagtaatttaaatttaactttttctgattggttatggtatggcttaccaataatgattattttgttgccgttgatgattgggattctttatattattttcaaaccaaaacttcatctcaattttgaacagacctttgaaaatattgaaatgaatcctatgcgtatattgacgtttattatttttccagtcattgctttaacgtggatatttagcggtaaaattaatccgtttatttcaggattactaggattacaaaaaaacattgcaagttttgatagtatcgtagccttattggcggcaattgttatttgttcaacaggcgttgcaagttggaaacaaattcaatcaaataccgattggggcgtattaatgcttttcggtggtggattaacattaagtgcggtgttgaaggattctggtgcaagtaaaattttagcggatagtattgtttttatgattgatggacaacatttctatcttattggtttattagttgcggcgttcattattttcttaactgaatttacttctaatacagcgagtgcggcgttacttgtacctatctttatttctatcgctcaatcattgggtatgccagaaattggtttagcattaattattggtattggtgcatcctgtgcctttatgctaccagtagcgacaccaccaaatgcgattgtatttggctctggtcaagtaaaacaaagtgaaatggtcaaagttggtttcttactgaatttagtctgtgttgtagttattgccactatgggttatatgttctggcttaaataatatagaattgtttacttttaataaatgatgattgaagatcataaatttaaacgtaagaagtacaataaagccatttaaataaatgggttaaagcaaatgaagctttaacccatttttcataaccgttctatacaaagctatttattgtgttcataagcataaagcgtattgctcatcaacattgcaacggtcattggcccaacgccaccggggactggtgtaatgtaagccgctttttcggctgctttatcaaactctacatcgcctactaattttccatctactcggttaattccaacatcaattactaccgcactttctttgatccaatcgccagaaattaaatttggtttacctaccgcaacgacaagtatatctgcttggcgaacgtggttttccaaatttttagtgaatctatgtgttactgtgacggttgcccctgctaataataattctaaagacattgggcggccgacaatattggatgcgcctacaattactgcgtgcttgccgtgtaaatcaatacccgttgtttctaatagtttcatcacaccataaggtgtacaagcacgtaaagttggaatacgttggcataaccgcccaacattataaggatgaaagccatctacatcttttttaggatcgatacgttcaataatagcttccgcattaatttgttttggcaaggggagttgcaccaaaataccgtcaatatttttatctgcgttaagttggtcaataatcgctaataattcattttgcgtggttgtttcagggaggtcataagatttagagagaataccgacttcctcgcaacttttacgtttattgcccacataaatttgcgaagcaggatcagcaccaacgaggattacagcaagtcctggagcgcgttttccttgttcaatataatgggttattttatctgctaaattagctttaatttgttttgaaagttcagtaccagagatgatttttgcggccattgagctatccttgatattatgtgatgaaaaagaaagcgtttgctattttaacgaacaatgatttttttacaatgaaaaagggggatatttcttaaagtggaataattttgaacaattaagttgaaaaatcaaaaatttcattgactgaaataaaaacaaacttataattgaccgcacttatcggcgagtagcgcagcttggtagcgcaactggtttgggaccagtgggtcgtaggttcaaatcctatctcgccgaccacttctttcgtattttcttgaaatttttataaaagaaatcctttgaatgcgcccttagctcagctggatagagcaacgcccttctaaggcgtgggtcaaaggttcgaatcctttagggcgtgccattcgttanctgtttaacnagatcctgtttagtttttccaaanataagtactttcagtctgtnagattttatgctcataanctgcatcatttgagtgaagaagcttaaatacactcttaatgatgcagataaaaacaatattttggctatttaagtattttccaagctctgaagccataaatggcaattactacaaaacagattaatggtaggataaaggaaaaatttactgctggaagtcccataacttcgccttggtcaataatcattccttgtagtggtggcattaatgcgccgcctacaatagccattactaaacctgcagctcctaatgtcgattcctcttttaagccatagagggcaataccataaatggtagggaacattaaaggcataaaacctgaggttaaaattaggcagtatagaccccatacaccgtcaataaagataactccgagaatacttaaaaaaccaccaatagcaaagagcatcagcataaattctgcttttaaatatttcattaatgccgtgctaataaagcgactgctaataaaaatagccatagcaatgatgttaaagttttgcccttcagctttagtaaaacctaaacgttcagcgtattgtacgataaatgtccaacacatgatttgaacacctacgtaaaaggcttgtgcgatcacgccttcacgatatttggctttttgagccagtcggcttactgctgttttaaagctgatttgtccggcctcttctatttttacggctggcatttttttcaatccaatgataataaacactgcaaccacgacaaaaccgagtgctatgtaaggatcgcgaatttcagctaaatcatgggtgcgaatactcattttttctgcttcagacagggtgtggaaaatcaaattacctgcagcatcacgtttgtcagattcaagattagttaggactaactgggaagcaacaaacatacctgtaattgaaccaagtggattaaatgattgtgcgaaatttaaacgtcgagtagctgtttgaggatctcccattgcgagaatataaggattggcagtggtttccaaaaaagcgagcccaaaggttaaaatataaagggagactaaaaagaaattaaatatttcatattgcgcagctggccaaaataaaaatgcacctattgcataaagagcaagccccagaagaatccccgctttgtagctatagcgactggcaaataatgccgcaggaatagccattgtgccgtatcctccataaaaagctaattgtaccaatgccgcttctgaggctggaatttccattactgtttgaaataccgcaaccatcggattggtaatgtcgttggcaaatccccaaagagcaaataagctagtaataagcacaaaggggacgatgaatttcttttctaaaactttggcgttcataatgttttcctcatgtaagtgatggggtataacaagatttaggattcttcaatacgtaatccataggtgtggaatttacctaacactacctgcatttgctctttgctgagcagtggaatttctaagcctgtagagagtaatttcaaataccaagacgctaatacttctacttcttgtgcgagccataaggctttatctaggttttctccgcaagtgattaaaccatggtgtgctagtaaaatggctttgctttctttgattcccgttgcgacataactagctaatttgtgactaccaaatgttgcataaggtacacaaggaatatgatctgtgccgcttacggctaccatgtaatgaattgcaggaataggtttttcgagaatggataagcctgcacagtgaatggaatgattgtggacaacggcatttgcttcagggcgagtatgataaacactcaagtgaaattgccattcgcttgatggtaatttattttcttcgtgtttgccatttccatcaacataaacaatattttctgtcttcattaagtgatatggcatacctgtcggggtaatcagcattccatctttataacgaacactaacgtttcccgctgtgccttgatttaaacctaattttgtcatttcaaggcaagtatcaatgattttttgtgataattctgctctgttcattttgtagtacctctattgtttataaaatgggagtaaccccttttttaatgataatgttgccatattttgcgatctcaccactgacaacaacagcataagcctgtttagcacgtgtataaaaatcgaagcgttctagacaggttaaatttggtgtgaaaccgaccgcactttcaatcgcatttaagtaacgagtttcaacattcggatctaaagaatctccctcaactgctttcatcatcaacagaggggcatcaacataagcgtcaaattcgaataagggagttattgcttcaagtaaaatatctatagatataccatctgcacgtattacatttttatgtagtgaatgtgcgggaaaatgggcgtcagctagaactatctcatcgccatgccccatttcggcgagggtttttagtaattcaggagaaagagctgggtgaataccttttagcattttgttgttccttctagtttgggtaaattcgttttcttgttggttgcatcgcttgctgtgccgcgtttacattttcgtaaatgcctacgcctgcaaaggtaaacattgcggcaccaagtacagtactttcagaaatgtccacaacatcaatcggtaaatttaaggtgtttgcacggatttgattccacaatacattttttgaaccacccccaacacaaattaagcttttagcttggaactgactgacttgatgtagcacggataaaccgtttttgagtttatttgccatatgttgtaatgcgctgacataaatttctccacgagtagcaaacatggaaagtccactgatattaccttgtcctagttggctaaaaataccttcaaaattgaccgctctttttcccgcattaaaagctttttctccctctttgatcattgtggtgtaatagtgatcgctgccataaacatcggaaaataataatttacctaaccattctatgacgccagaacccacccattgtaccgctggattaaagcaattggattgtgcatcaaattcagtggttaagccttgagaaacaaactcaaatctaggttctgcgtgctgggttctagccattaagatttcccaggtgccagaacttaacacaggctgattcagccctgcaccagacccaaacacagcaaattgagtatcatgtccacaagaaatgacaggtacgggatttaatccccatttctgggctaacggtgtacgtaattttccaactttttcacctgcataacgcataggagggaaatggttattacttaaacctagcgatgctaaaatcgatggatcccaattaccgctagtaaggtttgtcatcattgatgttcccgccattgtgtgatctgtagtgaattgaccagttaagcgttgagtgagcattgacgaaataaaaacgaatttagccattttttggaaaacatctggcttgtgtgtttttaaccaatgtaatttaaataaagtattaaaactgtattgaccaatgccgttacgttgataaagagatttgatatctaattgattagatagattttccattactggtatggtccgtgggcatttccatgaaataatcggataaagttgttgatcattttcatcaaaaggtgcgccatccacgccgaaagtggtaacagatattcctacaatatcttttaaatcaataccttgttgcattaattgattgagggtttgagttgcacaagaggttaatttttgccagatttcttcaatatcccaaatatgataatcagatgattcgattccttgttttgtattattagcaaggtgatgagaggcaagaatttgtcctttttcatttatcgcaatggtgcgtaaatttgttgcaccacagtcaaaaatcaatgcgatagccataaaaactctcctcagcgcagtcaaaaatcattatgtttttgaccgcacttttttataaaaacaaattaggggttatttataaagcggaccaaagttttggcaagctcgataatcttgcccttccttgtcttgaccaaatccattccaagcgctagggcggaaaatatttttctctgatacattatgcatacagactggaatgcgtaacattgaagcaagagtgattagatcagcccccacatgaccgtgagtcgctacacagtgatttgcgccccaatttgccatgactgaatacacatcagtaaatgcaccttttccagttaaacgtggaacaaaccatgttgttggccaagtttcattagtacgttgatttaatttattatgtacatcttgaggtaagtcgattgaccagccttccgcaatttgtaaaacgggacctaaacctttaataagattaatacggtgtattgtaaacggtatgccacctttggttaggaattgagaagataaaccgccccctcgaaaatattcgtgaacagcagggcaccaacgtgtattttctaagcagcgttttgcttcttcttcggtaacatcccatgctggttttaaagttggattgccttgagcatcttgatgttctcccgttccatcaagtgcagctgaacctgaattgattaaatgaatgaatccactttcaggtcgccatccagtaacacgctcaaccgaatcttgactccaataagtacgcacatctgcgaaaatttgagctttgccagttaattgatgcccaaataacattcctattgcatttaaactatcattttccgtggcaagaatataaggtggacgcacgccattccagtcataagttgaattgagcattgcctccataaaatcgccgtttggcaaatgatcagtccaatgacgctgcccttgaaaacctgctgcaatggcattatgacctaaggcttcttctgcataatttaatgttgctaattttggatttcctaccatcaaatcacgagtgataatggtcattttcacaacattttcccaaagttctgcacgctcttccgcattgcgttgattctctaggctatttacatcaaccccttctttgcaatattgtttaacccaactcaaggctaaatcaacttcttcttgatcataaattttgcggtctaaacggcgtttaatttccatcatatccacatattcattacgcatacctaaatattcttggaagaaagcttgatttacaatagaacctgcaattcccatggaaactgacccaatagataaataggattttcctcgaatacttgcaacagcaagcccagcacgagcaaaacgcaataatttttcttttacatcttcaggaatgtttgtgtcatcggcttcttgaacttctgtgccgtaaatggaaaaggctggtagtcctaattgagaatgaccagcaagggcggcagccaagtaaaccgcacctgggcgttccgtaccgttaaatccccaaattgctttaggcatgtgaggatccatatcaatggtttctgagccataacaccaacaaggggtaacggtaatggttaatccaacgttttcgcgtttaaatttatccgcacaggcggctgcttcggctacaccgccgatagtgctatctgcaactacacattcaacgaaagtaccatctgtatgacgaatatgtgtttgtaataattgagcaacagattgagccatacgtattgtttgggtttcaagagattctcgaacccccattcgacgaccatcaatagttggacgaataccgatttttatacgatttgattgagtagcaagagccatagttacactcctttgtttgtgcttaagtaagaatgatgaaatcactgcagaacaaatggtgttttcattgaattagagtgtgaaagaaaaatgataaggaaaacagtaagaaatgaaattttgttgcaaaactgcgagcatcacaaaaattgactatatttaaggaaatgtatatgaccgattctttcaatttttagtaattttcggtcaaaatggtcatttgtttttataaaacggtcattatatcgtgttgctcacaatatttttgtaagttatcgggaagtgaccgatcagaaaaaatggtattaattttgcttaaatcggcaagttgaatcaaacttgttttttcaaatttagaagaatcaattaacaaataagcacgttctgaagcttccatcatttttcgttttaaagaggcattcagctcgtttgattcccagatattaccgtttttatcaattcctgaacaagaaaacactgaaaaattaatatgtaatcgttgtaataagtactcagataagggaccgtaaaatgcttcatattttgctgaataaactccgccagtaacaatagttttaacattggatttattaactagggcattaatgttaaacattgaattggttactactgtacaaggaatatcgggcattaaataagcaaaataccaacttgttgagcttgcatctaaacctataacggcattttcatatagcaaatccaaggctttttgggcaatatgtcgtttagctgttgcattaatatgttttcgagtttggaaaaatgaacctaaatctttggttttattactcactgctcctccgtgggttcggtgcaataagcctttgttcgctaatttgttcaaatcgcgacgaatggtttccaccgaaatatcacaatgctgtgcaagttctattacactggcttttccttgttgatttacccattgtaaaattaattcatcacgataattcatctcttttccctatacggtggatttagtcgagattctagtttacgcttgagtatattgaaaatccaaggataaattatattggggtgacgtatatcttcctaaaagtgcggtcaattttttgtgagtttcttttcaagagtatgcaagctacaatacgcccccaagttttatcaatgtaaatcagaaagagaataattatgccctttgctattggtcagcgttggttaagtgaaagtgaaaacgctttaggattaggtgttattaccgcattagatcaacgaactgttactatttatttccccgcagcagatgaaacacggatatatgctatggcgcaagcacctttaagtcgaattgtatttagcaaaggcgaaacattatcccatcaagctggctggcaaggcgagattttagacgttcaaaatatgaacggtttgttgttttatttagttaaaaatccacaagatgaagatgttattgtgcaagaacgtgatatttcgccgattatttcttttagtcaagcgaaagatcgtctgttttcagcacaaattgatcgcagcactcattttgcattgcgttatcgcacgctttgtcatcagcaagcacaatttaaatcgccattgcgtggtttacgcggaacgcgtgcaagtttaattccccatcagcttcatattgcagctgaagtcggtaatcgagttaatcctcgcgtgttattggcggatgaggttggtttagggaaaaccattgaagcaggaatgattttgcagaatcaactttttgctgagaaagtgcaacgtgttcttattatcgtgccagaaaccttgcaacatcaatggctggtggaaatgcttcgtcgttttaatttgcattttgcactttttgatgaagaacgttgcaacgattttgatcttgatgcggttaatccattcacgactgaaagtttaattatctgttcgctgaattggttagaaacgcatccaaacagagtagagctggtgctcaatgctcaatttgattgcttaattgtggacgaagcccatcatttggtgtggtctgaaacctcgccaagtactgcttatttattagttgaacagcttgctcgtatcattccatccgtcttgttactcactgcaactccagagcaacttgggcaagaaagtcattttgctcgtttgcgcttactggatccagaacgtttctttgattatcaaacctttgtgaaagagcaggaacactatcaacctgtggttaatgccgttgaatctttgttggcaaataaggcattaagtgcggtcgaaaaaaatcatatttctgatttattgcttgaacaagatgtcgagccactttttaaagcgattgcatcaaataatgatgaagaacaacagcgtgcccgtcaggaattgattcaagccttaattgatcgtcacggcacggggcgaatgttattccgcaatacacgtcaaggcgtgaaaggttttccgcaccgtgtttatcatcaaattacactctctgaagagaatgataaaattgattggctgattgacttcctcaaactacatcgcaatgaaaaaatctttgtgatttgccagacggcggcaactgcgattcagttagaacaaattttacgtgaacgtgaggcgattcgcgccgcagtgtttcacgaaaaaatgtcgattatcgaacgggatagagccgccgcttattttgcggatttagaaaacggcgcgcaggttttactgagctcgagtattggctcggaagggcgtaatttccaattcgcagcaaatttagtgttatttgatttaccgacaaatcccgatttattggaacaatgtattggccgattggatcgtattggacaaaaacgtgatgtgcaagtttatgtgccttgtgcgaaagattcgcctcaaagtcgtttagcacgttggtacaatgagggattgaatgcttttgaacaaacttgtccaatgggaatggcattattttctcagtttgccgatgagttggaaaaagtgcggtcaaattctaccgcactttcagagaatgaattttctggattattaaaacaaactaaaaccgcacgggaaaaactcaagattgagttagaaaaaggtcgtgatcgtttattagagctaaattctcatggcggtgagcaagcacaagcattagcggatcaaattgctgatgaagataattcgccagagcttgtgaattttgctttaaaattatttgatattattggcgtagagcaagaagatcttggggctaatagtattgtaattagtccaactgggacaatgcttgtgcccgattttccaggtttaaaagaagaaggtgtgacggttacctttgatcgagaacttgcccttgcccgcgaagaaatggagtttctgacttgggatcatcctatgattcgtcaaggtattgatcttgttgcttcgggggatattggcaaagccgcaatggcattgcttgtaaataaacaactgccagctggaaccttattaattgaattgatttatgtggtggaaagccaatcgccaaaagggttgcagctcaatcgtttcttgccgccaacgcctattcgtctgctgcttgataacaaaggaaataacattggtgagcaggttgcctttgaaaccttgcatagcaaattgaaaccacttggtaaaaatattactaatcaaatggtgaaaatggcacggagcaacattgaatccttgatcatgcgaggtgatcaactcgtaaaatccttggcagaaccgattattgctgaagctaaaaatcaagcagatcaacaattaagcgcagaaattaaccgtttacaggctttgcgagcagtgaataaaaatattcgccaaagcgaaattgatattttggaacaacaacgaacacaatcacttgacgagctttctaaagcaaattggcgtttggattgcttgcgtgtcattgtgacgaacaaggaataaaaatggcattgattgaatacaatccgccccttgaaccttatttggatattatttatcaagataatcatttgtgcgtggtaaacaaaccgagcggtttgctttccgtgccgggcaatcaaccacaatattatgatagcgcaatgagtcgagtaaaagaaaaatttggcttttgtgagcctgctcatcgtttggatatggcaacgagcggtattattgtgtttgctttaagtaaggcggcggatcgtgaattaaaacgtcaatttcgcgaacgtgaaccgaaaaaacactatcaagcgattgtttgggggcatttggagaacgattatggcgaggtaaatttgccgatgatttgtgattgggaaaatcgacctcgccaacgtttggatttcgttttaggaaaaagagcggtcacaaaattcgaagttttagcacgtttgccgaataacagtactcgcgtgaaactgacgcccgtgacaggcagatctcatcaattacgcttgcacatgttagcattggggcatccaattctaggcgataaattttactctcatccacaggctaaagttatgtcgccaagattatgtttgcacgcagaagaattgacgattacccaccccattacaggggaaacaatgacttttaatgcgaagtccgatttttaaatttacgcataagcacgagatcacgaatgaaaaactttttagctcaacaaggaaaaatcacgctaattctcaccgcactttgtgtgcttatttatcttgctcaacagctgggttttgaagacgatattatgtatttgatgcattaccccgcttacgaagagcaagatagtgaagtgtggcgttatatctcacatacattggtacatttatctaatttgcatattttgtttaatctgtcttggttttttattttcggtggaatgattgagcgcacttttggctcggttaaattattgatgttgtatgttgtagcatctgccataacaggatatgtgcaaaattatgtgtctggccccgctttctttgggctttctggtgttgtatatgcggttctaggttatgtatttatacgtgataaattgaatcatcatttatttgatctgccagaaggtttttttacaatgttattggtggggatcgcattaggttttattagccccttatttggtgttgaaatgggaaatgctgcacatatttcaggcttgattgtcggcttgatttggggatttattgatagcaaattgcgcaaaaattcgctagagtaagtccgtttaatttggataaaggattcgctatgaaacaatcgttacgccatcaaaaaattattaaactggtggaacaatctggctatttaagcacggaagaattggttgctgccttagatgttagccctcaaacgattcgtcgtgatttgaatattttggcggagttagatttaattcgccgccatcacggtggtgcggcatcgccatcttctgcagaaaattctgattacgtggatcgtaaacaattcttttcattacaaaaaaataatattgcacaagaagttgcgaagttgattcctaacggtgcatcgttgtttattgatattggtacgacgccggagsstgtcgccaatgcgttgcttggtcatgaaaaactcagaattgtgacgaacaatctgaatgccgctcatcttttacgccaaaatgaaagttttgatattgtcatggcgggcggatcattacgaatggatggtggaattatcggcgaagctacggtaaattttatttctcaatttcgcctagatttcggtattttagggattagtgcgattgatgcagatggttcattattggattatgattaccatgaagtacaagtaaaacgagcgattattgaaagttcacgtcagaccttattagtggccgatcactctaaatttactcgccaagcgattgttcgcttgggcgaattaagtgatgtggaatatttgtttacaggtgatgttcctgagggcattgtcaattatttgaaagagcagaaaacgaaattggttttatgtaatggtaaagtgcggtaaaaatatctttgattttcttattaatttgtcgataaaagaagctattactcttaatttttgatttaattgaaatttatctaaaagtaatctaaatattctctcgctgaattattgtcttttctataattaaacatttccaagcgtaaaagtatcttgcttttttaatcaattaaagaaatttcatatttctgtattatctaattatttttagctaccaatattctttaaaacattccgagcttagataagaaaatcccttgctgggcaagggatttagtaatgggttaaagtgcggtagaaattaccaaccttttacaacgccatctttaaagtgtttttgagcttcttggtaaacttcttctgtttggtaagattttatgaaatcttgaacagctttgctgtctttgttatcggtacgagaaacgataatgttcacatatggagaatctttatcttctacaaatacaccgtcatcttgagcatttaagcctacttgacccgcataagtattgtttactacagctaaatcaacgtcgtctaatgcgcgtgccgcaacagaagtatctacttcagtgatgtttaattttttcggattttcaacaatatctaatacagttgaaagaaggttatttgcatcttttaatttgattaaaccttgtttttcaagaagaattaatgcacgaccacggtttgttggatcgttaggaacaacaactttagcaccgtcttgtaattcattcacatttttgatttttttagaataacccgctaatggatagacgaaagtattacccacgataactaagttatttaaatttttcgcttttgcatcttcatctaaataaggtttatgttgcattgcgtttgcatctaaatcacctttagatacagcttcatttggtaatgcgtagtcattgaattcaacgaattgaacgtctaaaccatatttttctttagcgacttttgctgcaatttctgcaacttgatgctctgggccagacatcacgcctactttgattttaagcggtgctgctgcagcttcaggttttttgtcttctttacagcctgttaaaacgagagctgatgcgattgcagtgattgcaaaaagttgttttaatttcataggatttccttcctgtttaagttaagagttgcgtttaattaacgatgatccacttttttagccagtgtatcgccgagtttttggctaatcataacgaatagcacaataataatggttgccacccaagttacataaggcatattgcgatatacgcccgtagttgatagcgaggctacctaaaccaccgcccccttgtgttcctgccattgcagaataaccaactaaagtgactagcgtaagagtaacgccattaattagcgtaggtagagcttctgacaaatagaatttacgaacaatttgccatttagtagcccccattgcttgagctgcttcggttaaaccatttggaatttccattagtgcattagcagttaagcgagccacgaatggcattgcacaaatactcaatggaataattgctgctgttgtacctaatacagttcccacgatgaaacgagttacaggtaataagattaggagcaaaataataaatggaatggaacgcccaatattaataatcgtgtttaacacaaaatgagtgcggttattttgtaaaatctcattttttccagttaaaaaagtccatatgccaacaggcacgccgactagtacagcaagtagggtagatgcaaaactgatataaacagtttcataagttgcggttgcgacaacgccccacatttgaggtgttaattgctggctgaatgttgccaaaaaatcattgaacataaccaagcacctccacgcgcacgttgttttccattaaataaactttggtttgcgtaatggcatcttcatcgccttctacttcagcaatggtataaccaaatttcacgcctccagcataatcaatttgtgaggttaagatactgagctccacgccaaatttttttgatgcttgagaaagtaacggtgcatcgactgagcgacccgtaaactcaaatttgatgattggataggctttactatgtttcggtgtatcagtaagattttccaaatattcatcaggtagactgatgtggaaggtcgaacgaataaactcttgtgctaattctgttttagggtttgcaaaaatttcaccgacagtaccttgttcaactaggcgaccttgatcaatgacagcaacttgatcacaaatctgtttaacaacttccatttcatgagtaatcaataaaatcgtaatacctaaagtgcggttaatttcctttaataatttcagaatagattgcgtcgttgcaggatctaatgcgctcgttgcttcatcacataataagactttaggatcgctcgctaaggcacgtgcaatggctacgcgttgtttttgcccgccagaaagattgcttgggtaagcatcacgtttttcacttaaaccaacaagatctaaaagtgcggtaattttttcttggatttttgcttttgactcactttccaattctaagggtaatgccacgttttcaaagacggtgcgagaacttagtaaattgaaatgctgaaaaatcattccaatttgacgacgagcaagtactaattcgcgatcagaaagttttgttaattctacgccatcaacaataacggaaccgcttgtcggtttttctaataagttcacacagcgaattaatgtactttttcctgcaccagatgcaccaattacgccacagatttgacctttttcgatattcaacgaaacattatcaagngcagtcaattttttgntcggtagctcaaaaattttcgnaatattatttagcttaatcatataagccctttttatttattgtttttaaatctgttttggtattctagatgtctagattgctatgtcaatatgtcagattatcttttttagacagattagttatgacttatatttgctaattgcttggattaaatagataatttttgtcaatttgacatgtataaaaggtaagagaatgaataaggctatttttttagatcgcgatggcacgttaaatattgattatggttatgtacacgaaattgataactttaaatttattgatggtgtgattgatgcattgcgagaattaaagaaaatgggatatatgttggtattagtgaccaaccagtcgggcattgcacgtggttatttttctgaggatcagtttttacaattaacagaatggatggattggtcgttagctgaacaagatgtggatttggatggtatttactattgtccacatcattctgagggaaagggcgaatataaagaagattgtgattgtcggaagcctaaatcgggaatgttattgcaagcgatcaaagaattaaagatcgatcctacgcaatctattatggttggagataaagttgaagacctaaaagcggggattggtgcgaaagtaaaaatgaacgtattagttcgtactggtaaaccagtaacaggggaaggagaaggaatagcggattatgtgttagattctatcgtagatcttccgagaattttaaaacgcttaaaaaaatagccaaaaagatctatattttgctctaatcgcttgtactttaatcaaaagatcatttttttaaatatttttacaaaaaagtacttgcaagggatttgaaaatccctataatgcaccgcacacaacgacgcactgttgtgaagttttttaagtttccaagtgcgtcgttattttttgctctttaacaatatatcagacaatctgtgtgggcacttgttgattgacttgttttaaaactatttttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaagattaaaaacgaagcgaaagcaacgttgaaaaataaacgttaaaagataaaaagaaaatagagtatctttaattgatgtccccatcgtctagaggcctaggacatcgccctttcacggcggtaaccggggttcgaatccccgtggggacgccaattaaagataactttattagattgtcttactgttctttaaaaaattggaaacaagctgaaaacaagagattttcgagagaaagtctgagtaggcaaaacagtaaagtgaaagagagaactgaaaaggaaactctaaaaacaaaacctgttttgtaaaaaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcaatatagtgaggagaatgtgttgggaagcacaatcaaagagggtgataatcccgtatctaaaaaccatattgtggtactaagctaacgagaagtagggcgggacacgtgatatcctgtttgaagaaggggggcccatcctccaaggctaaatactcctgattgaccgatagtgaaccagtactgtgaaggaaaggcgaaaagaaccccggtgaggggagtgaaatagaacctgaaaccttgtacgtacaagcagtgggagcgagggcaaccttgtgactgcgtaccttttgtataatgggtcagcgacttatattttgtagcgaggttaaccgaataggggagccgaagggaaaccgagtcttaactgggcgaatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctagggggccatcccggcttaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcagaatttattctgttgggtaggggagcgttgtgtaagcggaagaaggttcatcgagaggtgggctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtaagggctagcccctgaaggttgaaccggtcgaagataccagctggctgcaactgtttattaaaaacacagcactctgcaaacacgaaagtggacgtatagggtgtgatgcctgcccggtgctggaaggttaattgatggtgtcatcgaaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgtaggatgattgattggggctgctcctagtacgagaggaccggagtggacgcatcactggtgttccggttgtgtcgccagacgcattgccgggtagctaaatgcggaagagataagtgctgaaagcatctaagcacgaaacttgccaagagatgagtcatccctgactttaagtcagtaagggttgttgtagactacgacgtagataggttgggtgtgtaagtgatgtgagtcattgagctaaccaatactaattgcccgagaggcttaactatacaacgctcaagtgtttttgggagctaagtgaagtaagagatgaaaagcgaagcaaataaaagcagagcgaaagagaagtaaaagactaaacaaagaaaagtaaatatagaagacttaatagaaagaaaatcggattcagcttgtgaccaataagaacgagtgaaaggtagaggaaagactgagtaacgagagataaaagagacgagagataaaagagaaaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaaggaccccgtgtcgaaagatatggggttttagcttttgggaatttattcattatttaatcaaataagtgtctaattttaattttcaataagtaagtaatttttcaactcatatgaagtcacattcctataaatgttttattagctgtgctataatcccactaaaattctacccttaaaaacaagagaaattatgaccgcacttaatgtattaatttatcctgatgatcacttaaaggttgtctgtgagcctgttactaaagttaatgatgcaattcgtaaaattgttgatgatatgtttgatacgatgtatcaagagaaaggtattggtttagctgcacctcaggtggatattttgcaacgtattattactattgatgttgaaggcgataaacagaatcagtttgttttgattaaccctgaaattttggcttcagaaggcgaaacgggaattgaagaggggtgtttatccattccagggttccgtgcgttggttcctcgtaaagaaaaagtgacagtgagagcgttagatcgtgatggtaaagaatttactttagatgctgatggtttgcttgcgatctgtattcaacacgagatcgatcatcttaatggaattttatttgttgattacctttctccacttaaacgccagcgcattaaagaaaagttgattaaatacaagaagcagattgcgaaaagctaaaacgtagggtgggctttagccagcaatcatttcaaaaaacggtgggcttaagcccaccctacttcctatcaattaccataacgtagaacattatgaaatcacttaatattatttttgctggtacgccagattttgctgcacagcatttacaagccattctaaattctcaacataatgtgatcgctgtttatactcaacctgataaaccagctggtcgcggtaagaaattgcaagcaagtcctgtaaagcaacttgctgagcaaaataacattcccgtttatcaacctaaatccttacgtaaagaagaagcacagtctgaattaaaagcgttaaatgcagatgtaatggttgttgtggcttatggattaattttaccgaaagctgtattagatgccccccgtttgggttgtttgaatgtgcatggttctattcttccacgttggcgaggtgcagcaccaattcagcgttcaatttgggctggcgatgtacaaacgggtgtaaccattatgcaaatggatgaaggtttagatacaggcgatatgttacataaagtctattgtgatattttaccgactgaaacttcaacgagtctttataacaaactggcagagcttgctccatcagcattaatcgatgttttagataatcttgaaaacggtaaatttatagcggaaaaacaagatggcagccaaagtaattatgcagaaaaactttctaaagaagaggcgcaattaaattggtcactttctgcaatgcaacttgagcgtaatatccgcgcttttaatccttggccaattgcctatttttcaacagaagacaaggatggcaatgcacacactttaaaagtgtatcaagcgaaagtgttgcctcatcaagataaaccagcgggaactattttaagtgcggataaaaatggcattcaaattgcgactgtcgatggcgtcttaaacttattgcaattacaatctgcaggtaaaaagcctatgtctgcacaagatttattaaatggccgtgcagaatggtttactattggtaaggtgcttgcataatgaaaaaattctcttctaaaactatcaaagcaaaaaattcagtaaaaatgaccgcactttcgaccagggctattgctgcaaacttaattttgcaagtattggatgagggcaaatcattgtcagcgttaattccagaagtgcaactttctgtaaaagctcaagatttgcctttactacaagaaatttgttttggcgtgtgtcgagtattgcctcgcttagagcaaattatcaaacgtcttgtggataagccgcttaaaggtaaaactcgcattgttcattgcctgttacttgtagggttataccaattgctttatatgcgagtgcctgctcatgcggcagttgatgaggttgtgaacgcaacaaaatcattaaaatctgatagttttagaggattagtgaatgcggttttgcgtagatttttacgtgaacaagatgaaattttggcaattatcgataaaaattggcaaacgcttcaccctgaatggttcgtgaataaattaaaaaaagcctatccgaattggcgtgagatcattgaggcgaacaatcagaaaccaccaatgtggctacgtgtgaattcacaaaaaaacgccctcgaaacttaccgcactttacttgaagaacaaggtgtttcttcgaaaacaagccatcatcctaatgcgctatgtttagatataccgattgcggtgcaaaaattaccacactttgaagaaggggcggttacggtgcaagatttgagtgctcaatgggcggcaacgttgcttgagccaaaaaatgaggagtggatcctcgatgcttgcgcggcaccaggcggtaagacgacccatattttagaactggcacctcaagctaatgtgattgcattagatgtagaatctcatcgcttaaaacgagtagaagaaaatcttgaacgtttaaatcagcaagcgatagtggtgtgtggtgatgcgagtaaacctgacgaatggttagctgaaatcggtaaaagtgcggcgaaatttgaccgaattttacttgatgcgccttgttctgcaacgggggtgattcgccgccaccctgatataaaatggttacgcaaagaaaccgatatcgctcagctcgttgaattacagaagaaaattttgagtgcactttgggaaaaactgaagccaaacggtgttttgctttatgcgacttgttctgtattgccagaagaaaattgcgaacaaatccaagcatttttaaatgctcacgcagatgcggagttattgtcattgccctttagtgatgataaaagtgcggtgggttttcaatttattccgcaaccaaatagtggcgatgggttctattatgcgaaattgcttaaacgagcatcataaaggagggtgataatgaaaattatcattttgggtgcaggtcaggtaggaacgacgcttgcagaaaacttagtcagtgaagataacgatattaccttagtggataatgaatctcctcagttacaaacattgcaagaaaagcacgatttgcgtgtggtacaaggctctccatcatctccaaaagtgcttcgtgacgcaggcgcggcagatgccgatttaatggttgctgtgacagcctctgatgaaatcaatatggtcgcctgccaaatgggctatacattatttaatacgccaacgcgaattgcacgtatccgtaattcagaatatttacgtgaaaaagacaagttgttcaacaatgaaaatattcctattgatcatttaatttcgcctgaaaatcttgtaactgatgaaattacacgtttaattgcttatccaggcgcattacaagttgcccattttgccaataatcgtattagtattgttgtagtgaaagcttattatgggggggctttggttggatatgcactttccgcatttcgcgaacatatgccacatattgattgtcgcattatgtctattttacgtaatggcaaaccgattcgtccacaaggctcataccattgtagaagctggcgatgaaatcacgtttatttgcgctactgaacatattaaggcgataatgggagagttacaacgtttggagaaaccttataagcgagtaatgattgttggtggaggaaatgttgcttttggcgtagcaaaacgtttggaaaattcttgtactgtaaagcttattgaacgagattcaaacagagcgcaagccttagcagaaaagttgccaaaaacgttagtatttaatggagatgcctcagaccaaaacttgctttttgaagaacatattgaaagtgtggatgtatttctttcattaagtagcgacgatgaagcgaatattatgtcagctttgttagccaagcgtttaggtgcgaaaaaagcaatggtactgattcaacggattgcttatattaatcttattcagggaggcacgattgatattgcggtttctccacaacaagtaacgatttctgctttgttaggtcacgtgcgtaaaggcgatgtaaaaaatgtggcaacattacgacatggcattgccgaagccattgaaattgttgcacacggtaatgtgaatacttcaaatatagtagggcgaaaaattggtgagttgcgtttgccgatgggaatcattattggtgctttattacgagggaatgatgtaattattgctcgtcgtcaagtgattattgaagaaggcgatcatatagtgatttatttaagtgataagaaaaatgtgccagaaattgagaaattattccaaccaagcgcattctttatttagtttttttacttttcagagtgatttattataatagtcgctctttttatgtaatttttgaaggggaacattattatgaattttattaaagaatttcgcgaatttgcaatgcgtggcaatgtcgtagatatggctgtcggtgtgattattggtagcgcatttggcaagatcgtaagttcacttgttagtgatatttttacgcccgtgttggggattttaactggtggtattgatttcaaagatatgaaatttgtattagcacaagcacaaggcgatgttcctgcagttacgttaaattatggtttgtttattcaaaatgtgattgattttattattattgcttttgcaatctttatgatgatcaaagtaatcaataaggtaagaaaaccagaggagaaaaaaactgcaccaaaggcagaaacattgcttactgaaatccgtgatttattaaagaataaataatatttaaagaatgaaagttagcagaaatgctgactttttttattactattttttaagctataatcagccctcaattttagggaaataaaatgaaaaaatataataaacttcgcattgaatgggattgtcgccgaggaatgttagagttagataaaatcataatgcctttttatttgacgcattttcatgaattaacggatgacaaaaaagatatctttattcgtttattagcaagtacggatttgcagttattttcgtggttttttaatcttgcgaaatcacaagatgtagagcttcaaatgatggttgaatatattcaaaaagtgcagaaaatcatcataaattaaaattattgattagcgaatgaacttttttaacacgcttttgtctgaacaagcaacaagagcttgctgtcttgatattaaggcgtgttagatattggcatgggagaaatatggctgaacagctaacagatcaggctttggtagaaagagtacagcaaggggataaaaaagccttcaatttgttggtttcgcgttatcaaaataaagtagcagggcttttgacccgatatgtatcgcgtaacgatattcctgatgtggtgcaagaatcctttataaaggcttatcgctcaattgaatcttttcgtggcgaaagtgctttctatacatggctttatcgaattgccgttaatacggcaaaaaattatttaacggctcaaggtcgccgtccaccaaatgaagatattttggcagaagatgctgaaaattatgatgtgggaacacaccttagggatgtggatacacccgaaaatgagatgttgtctagtgagttagaaagaattgtttttgatactattcataacttaccagaagatttaaaaactgcgattacgttacgagaactagaaggtttaagttacgaagatattgcagaaattatggattgtcctgttggtacggttcgttcccgaatcttccgagcaagggaaatgatcgaaaataaaattcaacctctaatgtagagcgaataacaatcggagtttactatgcaaaaagagcagctttcagcctatatggatggagaacaagtcgaaactgacttgatagatgctttattaagagacgaagaattacaagcgtcttggcattcatttcataccgttcgttcagtaatgcgtaaagaaagtgcggtctttttaggggctgattttaccgctaaaatggcagatttgattgagttagaagacgtgaagaaagttgatgtcattgctgtgtctcaacctgaaccagaagacgcacataattctgtatttatgcaaaaattaaaagcgttctttgcaccaatgacgcaagttgctgttgctgctggtgtatgtttagtggcagtacttggtgttcaatctttcaataataaaaacgatgcgtctaatttacctgagactccagtattgcaaaccttgccatttaataatgcggttcaagaggttagctataatgcgccaagtaaagatacattaacttcagatcagcttgagaaaaaaagtcgtcgcattggtgcaatgttgcaaaattatgaattgcaacgtcgaatgcactctgatgctttagatgtaagtagcagtcaagtaagataaattggtttcctttgttcagattattgattcaccacctaattgttatttagtgtggtgaatttttatcctttagatttctatgaaaaaaatcccattaaaatttaccgcactttctctttctttgctattaagtagcattgcttctgctgaagagctttctgcgaagcagtctttagataaaatgacacaagcattggataatctcaattatgaaattgcctttgtgcaaactactccagcaaatatggattcatttcgttatcgacatatcaaacaagataacaaaacctacgcacaattagttactttagatggtcgccagcaagaaattattcaacgtgataatttagtcagttattttcagccaaatgctcaagcatttacgcttaatagtggcaatatagttgatgcgatgcctgcggttgtgcgtgcaaattttgataagctttcttctgattatgatttcgtaaaattaggtaaagatcgcgttgctgggcgtttcgctgatacgattagaattgttcctaaagatgattttcggtatcaatatttggtgtttatcgatgaagaaaatggcttgttattacgcagtgatatgcttgatcgcgaaggcaagctacttgatcaatttagagttgtaacactttacatcgatgacagattgagaggattaacggattatattaacaaggtatcattgccccctttattgaaagaaagtaaaaatgaacaaagttcagatataacttggtctgcaggttggttgccacaaggtttttctttaattcgatatactcaagaaatattagaaaatgaaatcatagatagtgcattatatagtgatggcttatttacttttacgttgtttgtctctaatgtaggctctaatgacctaccagaaaatacttggaaacaaggggcttatacgatttatagcgaggtcatcggaggaaaagaaattacttttattgggcaattaccaatctcgacggcaaaacgcattgtacaagaagtcaaatttagataaaaagtgcggtaattttttacgatatttttatcaataactgattttgagttaggcattgactaagattcgcacgtttttacgtgcgaatttttattttcttaattttattaattctacttggtgattatgacctttttttagaattaaatttgctcgctcacgggttggaagaatgttttgattgagatttaatccgttaatttcatcccagattttacttgccgtcgcgatagcctcttcttttgataagcttgcgtaatgtttaaagtaagaattaggatcgttgaatgcactttcgcggaatttcagaaatcgtttgatataccattctttcaataatttttcttcagcatcaacataaatagagaaatccacaaaatctgatacgaatgtttgatcggttttattattacccgtttgaagtacattcaagccttctaaaataagaatgtcaggtttatctaccacatcaaatttatcgggaataatatcgtatgttaaatgagagtaaattggtgctgtaacattgcttttacctgattttacatccgctaaaaagcgaatgagtttaggtgtgtcataagaaacgggaaaacctttcttttgtaaaagattatcttgtttaagcttgtttaatggataaagaaacccatctgttgtgatgagatcaacttttctttcagttggccaatgagaaagtagagattgtagaatacgtgcagaagtgcttttcccaacagcgacactgccagcaatactaattatgtaaggtgttttggcattatttctgcctaaaaaacgatgtagtaccgtttggcgatgtaaattttcatcaatgtaatagttaataagacgagttaatggtaggtaaattgtacttacttcatctaatgaaaggtcttcattaaagcctaagagtggtttgagatcctgttctgtcaattttaatggaacggatttacgtaattccgcccattgttcacgattaaagcttaaaaaaggtgtttgctgagttgaaaattccacaataattttatttgatggctaaataaacagagaaaaatatacgctataaataaaaatttagcattcatttttcattaaatgtacgctaatttgattaaaaaatcacttttttgattgtgatttaaacgaataatcaaaaaaataaacttttttataaaaaatacttgtcagttaaagttttttccatataatacgcctcacttgcttacgacacgccgacttagctcagtaggtagagcaactgacttgtaatcagtaggtcatcagttcgattccgatagtcggcaccattctttcgtatcaagtattcatttagtgtggaggggttcccgagcggccaaagggggcagactgtaaatctgttggctcagccttcgaaggttcgaatccttctccctccaccatcttttagatggatcctgatgggacagacgaatttaggacttgcgggcatcgtataatggctattaccttagccttccaagctaatgatgcgggttcgattcccgctgcccgctccagacgctgatatagctcagttggtagagcgcacccttggtaagggtgaggtcggcggttcaaatccgcctatcagcaccagtcttataattcctcatccttatatcaatcagcaaataaatttattggttaatgtggtttaatttacccatcgataaccgtgtctatttagagggactatttcaatgtctaaagaaaaatttgaacgtacaaaaccgcacgtaaacgtgggtacaatcggccacgttgaccacggtaaaacaactttaacagcagcaatcacaaccgtattggcaaaacattacggtggtgcagcgcgtgcattcgaccaaattgataacgcgccagaagaaaaagcgcgtggtattaccatcaacacttcacacgttgaatacgatacaccgactcgccactatgcacacgtagactgtccgggacacgccgactatgttaaaaatatgattactggtgcggcacaaatggatggtgctattttagtagtagcagcaacagatggtcctatgccgcaaactcgtgaacacatcttattaggtcgccaagtaggtgttccatacatcatcgtattcttaaacaaatgcgacatggtagatgacgaagagttattagaattagtcgaaatggaagttcgtgaacttctatctcaatatgacttcccaggtgacgatacaccaatcgtacgtggttcagcattacaagcgttaaacggcgtagcagaatgggaagaaaaaatccttgagttagcaaaccacttagatacttacatcccagaaccagaacgtgcgattgaccaaccgttccttcttccaatcgaagatgtgttctcaatctcaggtcgtggtactgtagtaacaggtcgtgtagaacgaggtattatccgtacaggtgatgaagtagaaatcgtcggtatcaaagatacagcgaaaactactgtaacgggtgttgaaatgttccgtaaattacttgacgaaggtcgtgcaggtgaaaacatcggtgcattattacgtggtaccaaacgtgaagaaatcgaacgtggtcaagtattagcgaaaccaggttcaatcacaccacacactgacttcgaatcagaagtgtacgtattatcaaaagatgaaggtggtcgtcatactccattcttcaaaggttaccgtccacaattctatttccgtacaacagacgtgactggtacaatcgaattaccagaaggcgtggaaatggtaatgccaggcgataacatcaagatgacagtaagcttaatccacccaattgcgatggaccaaggtttacgtttcgcaatccgtgaaggtggccgtacagtaggtgcgggcgttgttgcaaaaatcatcaaataattgatggattcctgaatgtcttaaagataaaagacagaagaaacaaaagaaaagtgcggggaaaattctccgcacttttttattttatatatgtaaatatttactaaattatctgattttggattagaactaaatgctcactggtcatctaaatatcctgttgcagtttggtttgtgttacccctaggaatggtattgccggtggtatctttaccccatcactgacaacaggcgcaggcattggcacaatgctttgggatctaagtggtggtatggttgatcaacgttttttggtgattttatgtatggtggcatttttagctggctgcacacaatcgccagttacagccagtgttattgtaatggaaatgacaggtgcacaacccgttctcatttggctcttgatttccagcattattgcatccataatctcgcaccaatttagcccaaaaccattttaccactttgctgcaggctgttttctccagcaaatgcaagctcgccaagccgaagaattacgtagcaaaaccgaacaagagaaataaaaatgcctcaaaatctaccgcacttttaccgcggccgtttttctgttgcaccaatgttagattggacaacacgccattgtcgttattttcatcgccaattttcaaagcacgcattactttacactgaaatggtcacagcaccagcgattatccacgcaaaatacgaccacttggattttgatttacaagaaaatcccgttgcgttacagctgggaggaagcgatcctgaacaactcaaatattgcgcaaaacttgctgaggaacgaggctatcacgaaattaatcttaatgtaggatgcccttctgatcgcgtacaaaatggaatgtttggtgcttgcttaatggcgaaagcagatttggtagcagactgtgtagaacaaatgcaaagtgcggtcaaaattccagtcactgtgaaaacgcgtattggcattgatgaattagacagctatgaatttttatgtgattttattgaaaaggttcaaggaaaaggttgccaagagtttattatccacgcacgaaaagcttggctttcaggcttaagtcccaaagaaaatagagaaattccgccattagattatattcgggtgtatcaactaaaacgtgattttccacatctaactattgcaattaatggtggtataaaaaccattgaagaaatgaagcaacatttgcaatatgtggacggcgtgatggttgggcgagaggcctatcaaaatccaagtttacttgggcaaattgaccaagccttatttgatcctaacgcaccaattgttaccgctcatgaagcggtagagtcaatgcttccttatattgaacaacaacttagccaaggaatacaccttaatcatatcgtccgtcatatattaggcgcattccaaaattgcaaaggtgctcgtcaatggcgacgctatttaagcgaaaatgcgtttaaacaaggcgcaggaattgaagtggttgaaacagccttaagctttgtagaaagctaatcctaaaaacaaaataagccgcaaaagtgcggcttatttttcagctgtttttcttacgcaatacgcatttgaaaaatcaccaattcagcttggcaacagaaagtgaaatctgcctttaataaatagccatcatccacttttgtaatttcagttgttatagggggacataagccgagacctataaataatatcactttgggttttagagataactaaaactcaaactgaacagacattctgtaatttctgccaggtgcgtagaagcggtttaagcctttacctgttgctgtttctactcggttaattgtgccaagatgtcgaacagaacgggcagagtcccaagtgagatattttttgttggttaaattatatacaccagcggtaaatgtaagatttttaattggtttccaataggcaatcgtatcgatcactgtatagcgattattacgccataatccgcgagaatcttttacgtctttgccgtttgcttgtgtagcaggtacagttctttcagtgccataaatattttcttttcgtttgaccatactcgtccattgagaattaaagctatcttttgcttttttggctgcaacatcggtgatatacacatccatgccccattttttgcttggtgcatcatagccaatattgtataccgatgtggttggttgcaatgcattcataggctgatcttgtgaagcaatagcagtatattgcggatttagcttcaaaaattcagcatatccagaacgtaatttgttatctttaattcttcctttttgataggtcaatttataacctaaatggaaaccttgtagtttttcaaacaaatcacccatttcaagacgtgaagcaatttcgatacctctgactcttgcttgatctcgattttggttttgataaaacggatattctattgcagaacctttatcaatttgtttatttttttcaaagaccaaatcaataaaattacgataatcactttgaaatgcacttaacgtaagataactattttccttataaaaggtaaatgcgacttctttcgtttttgctgtttctgcttttaaattggtatttggacctatggaaaaatctggatgcttgaatgtcatataaatttcatcagaggttggtgcacggaaagcattagcatatttaagctgtacacgaagccaatctgtgggatcaagatttaaccctaaattgtaagaatgatgtttatagtcagttttgcgtaataacagggcaagattctcttcaaaattttttttataacactcagtgttatagcgacaatccttatatccgctaggaacatacgcgccataaacgacatctttttcattaaaaggtacaaatattcctgcaattaagccacctggaactggagttttttcatcataaccaggcaaatattttacgtggtcatagcgataatttaaatctagccctagccaagaggtaagttgcacattatctccaaaatacaacacattatttttagtggtaacagggattaaataggtatctttgcctatgtcggaatgaagcggtgtaccattgacacaaccagctacgctgacattagggtgtggtgttttcttctcgccaagatttcccccctttgctctagcgcagaaaaagtagtcagcccaccattgcacattggctgcggtgttgtattggtgattaaccatactttttagtgttttttcataaagaccaccatattttagttggtgttgggtatgccataggtgaaattctttgtctaaatcaagtttaatttgttgggtatgggtgtttaaatcacggtcattaacgaagtctgtgctgtagccatagctttttggaaagagaaaacgagctgtttcttgtggaaagccattccacgacggtgtctttcccttttttagtgggattttgccatattttttcccgttaggtaatgttccaacttctatttctctatcatcataagtgtatttttcactggagttttcatcgtattcttgataaattctaaattttttactacaatctaatttttcacaattaattaaaacagaatcaagtgaactgcgttgtgaaatatccttatcagcatcttcacccttactattcttaaattcatgagaccagccaatttctttgctttcaagttcacctccatatttatccttaattttataaacccctttttcttctactaaatgcaatccttgggggttacttacaccattacaagtggattgatgacaatattcatcagaacgtgctttattggtgattttttgtgaagaataacttagtttaatatgatcccaaaaaggcgtttgactgaaattttcataactaaattgaatattttttcgtttggattgatcgttaataatacgctcaccgtatttttcattgttagctgtactatatggtctaagagcgtaagacaaatctataccctttgtttctaaagtagaatcatctaatgccacactcaagcgatggttttcattaggctgaaagcccagttttattaatgtgctttggcgggtaatttgataaggatcggctttttcacgggtaggaccaaccgctcttaaatccgcctgtttattgggataaattttataatcgtagttttctatttcgtgcccatcacgcgttgtatcaatgattaaaatatcaaattttttagaacgtcctgctaatgtaagtgtcttaaggttttgattattcattgtttgatagccacgtttataggaaagataataatctttatctatcagataatctcgagcatctttagtttcaaatataacagagccacccaatgcgccactaccagattttaaggagtcagcacctttggtaatagttgctgttttaacattttcaatttcaatgctattacgagtattattaaaattgccatagccttcaaatagttctttaaatccttgagagcttaaagtttcagcttgacgaagcccatcaaccataatacctacacggttttcatcaacccctcgaactgcataaccacttgcgcccgttctacctgtttcaaccaccgtaatacctgtttcatagcgaacgagatcacgagaatcagacgcctgctgtttcgctaattttttggcagaaatttgggtttccccgacttttttctctttgacattaatattttctgatgaacctgaaacattaatttgttctagttgttcagaaacattactattttggttggttggttggttggttggttggttggttggttggttggttggttggttggttggttggttggttggttggttggttgggcagcataggctatgcttgcatttaatgcaaatgcaatagagcaagcaagcaggctgaatttaaagttggtcataggtttccttattcttaatgataataattgtcatatattaaataattcaatttatctaatcaatatcaaaatgaaaaagtaattgtagggtgggctttagccacaacaaacaatcgtaagatattttggtgggctgaagcccaccctacggaaagtacgcattgattacgtacttctttttaggagtaatcattatgatgattttatgaattgcgtagtgttattgatttagtaattgtagggtggctttagcccaccaacaaacaatcgcgagatattttgtggctaaagcccaccctacgtttgggataggttcaaaataagccgcaaaagtgcggcttatttttcagctgtttttcttatgcaatacgcatttgnaaaatcaccaattcagcttggcaacagaaagtgaaatctgcctttaataaatagccatcatccacttttgtaatttcagattgaatttcacaaggttcactttctacatcacgtgctttctgagtaaaaaatgcgagtgcttcttgcgcttgtccttcactgtcataaatatattcaataacctgactacaatcacgattatcgaaaagtgatttcatatcaaaagtattacaacctacacattcaatcggtttttcggtttgaattgccataatattatccttttattcagattattttgcagcgacaaaacccactgcttcatacactttcgccaaggtttcttgtgcttttgcacgagctttttccgcaccttgtcgtaagatattatctaataaagtttcatcattacgatattgatggaaacgttcttgtaaactagcaagtagggttgagacttcatccgctactgcagtttttaaatgtccgtacattttaccttcaaattctttttcaagatcagcaattggcttatccgtaaccgcagaaagaatatctaaaagattagatacccccgctttattttgcacatcataacgaacaacaggcggctcatctgaatctgttacggcacgtttaattttcttcgccacagattttggatcttctaaaagtgtcaccacgttgttgcggttatcatctgattttgacattttcttttcaggatcttgcaatgacataatacgcgcacctgcttttccaatgaaaatttcaggaatggtgaaaatattgccataaagtgcattaaagcggtttgcaatatcacgcgtaatttctaagtgttgtttttggtcatcgccaacaggcacgctttttgcttgataaagtaaaatatccgccgccattaacacagggtaatcaaacaaacccacgttaatattttctgcataacgcgctgatttatctttaaattgcgtcattcggctcatttcaccgaaataggtgtaacagtttaacacccagcttaattgcgtgtgttctggaacgtgagattgaacaaaaatagtacttttatttggatcaattccgcacgctaaataaagtgcaagcacatcaagggttgctttgcgaagggcaacaggatcttgacgaacagtgatcgcatgtaaatcaactacgcaaaaaatacattcataatcttcttgcattttcacccagttacgcaacgctcccaaataatttccgatagttaattcaccagaaggctgcacgccactaaaaacaattggttttgccataatcaatccttaataccttaaaactgttcacacatcatatcagaaactctaggcttttttaatgttcgagttcaaaagctaggttaaaaatgctatatttaacggaaacgttttcctgatatttactaatgaaaaactaccacgatattgttcttgcccttgctggcgtgtgccaatcagcaaaattggttcatcaacttgcaacagaaagtcgagcagattcagagacatttttaaccgcacttaatagccttttcattacccagcctcaacgaattgaagatgtttttggtggcgaagttcgtcatttaaaattaggtctagaaaccttaattcatcagctcaacgcgcaaggcgatcaaaatttaactcgctattggctaagccttttagcattagaaggaaaattatcgaaaaattccgatgccaaacaaacattgggcaatcgaatttctcgcctaaaagaacaagaaattcattacgctcgtgatagtgaaacaatgctatctattatggcaaatatttacagcgatattattagcccattgggcaaaaaaattcacatactaggctcgcctgattatttgcgacaagaactcgtgcaaaataaaatccgtgcagttttacttgcaggcattcgctctgccgtgctgtggaaacaaatgggcggaacaaaatggcaaattttatttttccgcagaaaattacttgccaccgcaaaacagatttattcttctatttattaatacaattctggagcaaacatttatgcaactctctacactgaccgcactttcccctcttgatggtcgttatcaagataaagtaacgccattacgtgctatttttagcgaattcgggttaatgaaattccgtgtagctgtggaagttcgttggttacaaaaattagcttcaacggcagacattaccgaagtaccgccattttctacgcaagcaaatgcttttttagatggaattgtggctaattttaatgaggccgatgctgcgcgtattaaagaaattgaacgcacaactaatcacgatgtgaaagccgttgagtattttctgaaagagaaaattcaaaacgaagtggaactagtgaaggtttctgaatttattcacttcgcttgcacctcagaagatattaacaatctctctcacgcattaatgttaagcaccgctcgtgacgaagtgattttaccagaatggcaaaaactgattgatgaaattactcgtcttgcagaagaatataaaacgattccattactttctcgcacacatggccagccagcttcaccaagcaccgtgggcaaagaaatggcgaatgtcgtttaccgcctaaaacgtcaatttaaacaactccaaaatgcggaaatcttaggtaaaatcaatggtgcagtaggtaactacaatgcgcatttatcggcatatcctaatattgattggcataaattcagcgaagaatttgtcacttcattaggtattcaatggaatccttataccacacaaattgagccgcacgattacatcactgaattttttgatgctgtagttcgctttaataccattatcattgattttgatcgtgatttatggggatacattgcattaaatcactttaaacaacgaacgattgcaggcgaaattggttcttctaccatgccacacaaagtcaatccaattgattttgaaaactcagaaggcaatctaggattagccaatgcagtgatgacccatttaggtcaaaaattaccaatttctcgctggcagcgtgacttaacagattcaactgtattacgtaatttaggcgtaggattaggttattgtttgatcgcttatgcttcaacacgcaaaggcatcagtaaacttgaagtaaatcaaccgcacttattagaagaactcaatcaaaactgggaagttttggctgaaccaattcaaaccgtaatgcgccgctatggaatagaaaaaccttacgaaaaattaaaagaattaacgcgaggtaaacgagtgacagaacaggctatgcgtgaatttattgataagttggatattccacaagaagaaaaattacgtttacaaaaattaacacctgctacttatattggggctgcagtggaattagtagaaaaactatcataggaatttggctcttttttcaacaatattctttacaagaacatagcttttctctataatcctgcgcctgtgttagtcaatctaacaaatttctggttggtgcttgacctattcaagccccatccaagaccgtaggggagtaatcttaattatcctacgtagatggtgaacagaataagaatttttcttgcttctgggcgccgaagtcatcctagtcttaggattaggtaaattaattccgagtaatcggagtgtattcaggagctaaaagccaatggcattaaatcttcaagacaaacaagcaattgttgctgaagtaaatgaagcagccaaaggtgcactttcagcagtaatcgcggattctcgcggtgtaactgttgagaaaatgactgaattacgtaaatcagcacgtgaagctggtgttacaatgcgtgtagttcgtaatactttattacgtcgcgcagttgaaggcacagattacgaatgcttaaaagatacgtttgtaggtccaacacttatcgcgttctctaacgaacacccgggcgcasstgctcgtttgttcaaagagtttgctaaagcaaacgataagtttgaaattaaaggtgcagcctttgaaggtaaaatccaagatgttgaattcttggcaacattaccaacttacgaagaagcgattgcacgtttaatgggcacaatgaaagaagctgcagcaggcaaacttgctcgcaccttcgcggcattacgcgacaaattacaagaagcagcttaattattaagcgtttcttacttcatctaactttatttattttaggaattgattgttatgtcattaactaacgaacaaatcattgaagcgattgcttcaaaaactgtaactgaaatcgttgaattaatcgcagcgatggaagaaaaattcggtgtttcagcagcggcagcagtagcagcagctccagcagcaggcggtgcagcggcagcagaagaaaaaactgaattcgacgttgtacttaaatctgcaggtgcgaacaaagtagcagtaattaaagcagtacgtggtgcaactggtttaggcttaaaagaagctaaagatttagttgaatctgctccagctaacttaaaagaaggcgtttctaaagaagaagctgaagcacttaagaaagaattagaagaagcgggtgcagaagtagaagttaaataatttctattttaaccactttaaaattcaaaaaaccgatgggaaaccatcggttttttcttatataaaagtttgttatagtttttacttaaaaacttaccatttgctatctttctaagatagaatattacccgttgttattgatgaataaagagaaaatttatgacaaaaaaagcattaagtgcggtaattttagcagctggaaaaggaacgcgtatgtattctgatttacccaaagttctacatacaatcgcgggtaaaccaatggtaaaacacgtgattgatactgcccatcaattaggctcagaaaatattcatttaatctatggtcacggtggggacttaatgcgtacccatcttgcgaatgaacaagtaaattgggtattacaaacagaacaacttggcacagcacatgcagttcaacaagcagcacctttctttaaagataacgaaaacattgttgtgctttacggcgatgcaccattaattactaaagaaacattagaaaaattaattgaagcgaaaccagaaaatggcattgcattgcttaccgtaaatttagataacccaacaggctatggacgaattatccgtgaaaatgggaacgttgtagccattgtagaacaaaaagatgcgaatgctgagcaactaaatattaaagaagtcaatactggcgttatggtatctgatggtgcaagtttcaaaaaatggctagctcgtgtaggcaataataatgctcaaggcgaatattacttaacggatcttattgctctcgcaaaccaagataattgtcaagttgttgctgtacaagcaacagatgtcatggaagttgaaggcgcaaataatcgcttacaattagccgcacttgaacgttatttccaaaataaacaagcctccaaattattacttgaaggcgtaatgatctacgatcccgctcgttttgacctacgtggaacattagagcatggaaaagatgtggaaatcgatgttaatgttattatcgaaggtaatgttaaactcggtgatcgcgtaaaaattggcacaggttgcgtattgaaaaatgttgttattggcaatgatgtagaaataaaaccctattcagtgctagaggattctatagtaggagaaaaagccgcaattggcccattttctcgtttacgcccaggtgcagaacttgcagctgaaacgcatgtcggtaactttgtagaaattaaaaaatctaccgttggtaaaggttctaaagtaaatcacctgacctatgttggcgattcagaaattggctcaaattgtaatattggagcgggtgtcataacctgcaactacgatggtgcaaataaatttaaaacgatcatcggtgatgatgtgtttgtgggatctgatacacaattagtcgcgccagtgaaagtcgcaaatggcgcaactattggtgctgggactacaattacacgtgatgttggcgaaaatgaattagtgattacaagagttgctcaacgacatattcaaggttggcaacgaccaataaagaaaaaataaaatagaataaaaaatcctacgtattatcgtaggtttttttataaaccaattttacaaatcgtaattaaaatcacataaaaaatgaccgcacttaatgttaataatttatttgctagtttaggtttatgttgatgaagacggtatagcattctagctgtaacagctagaataaagggataaacccaaaaaagcgttgaaaataaattgatttgccagcttgatagatagggatttttactaaatgctgtagaaattaataatgccattggacacaataatataggcgaacaaaaggcagcaagaccccaagcaaatggactaaatttagttggtaaagattgttttttcatattttaaataattaaaaataaatagatacaagaaagaaatataataaatatgttgaatagtaaagaatattttaatgaaagtaacaatgtagaaatggcgcacccgaaaggattcgaacctttgaccgctcggttcgtagccgagtactctatccagctgagctacgggtgcgtagatgatgctttaattattcataaccactttaataagatagagccgttttaaaaatggcgcacccgagaggattcgaacctctgaccgctcggttcgtagccgagtactctatccagctgagctacgggtgcagaataaataaaacaaacaatggcggtgagagagggattcgaaccctcgatggagctttttaaccccatactcccttagcaggggagcgccttcagcctgctcggccatctcaccacaatcagtgtgagcggtataatacgttttttagaaaatatgtcaaaccattttttgaaaaacacacctgtttgaatattttatctacacattaaatatattattgaataaaaatctactcatcattcaaaaatactaaaatcttagatattgtttcccgtcttaattcatcttgctcaaataacacctcatgtttagaatttagtgctgttaatgccccttcgttctattattaaaagaagaaccgcactttttgaagtgcggttatatttttaatagttttacgccacctgtttaggttgtttaaataccgtaacttctggtgctacgcctataaatttctcaatctgaacgatacaagtatttggtgaattgccttgtgccaatttagatgtaccttcatctcgagttaacacatttgcacaaccatttttacataatggtttttcactttcacctaagtacattgggtcataccatgcgccttcatggagagcgacagtacctttgatgatattttctgttacagccgcacctgcaagcacttgaccgcgtttgctatgaatgcgaacaatatcaccgtctttaataccacgagcagccgcatcttcagggtgaatcatcactggctcacgatcatttaccgcatatttttgacgtaatgaagtatgcgccaattgactgtgtaaacgatagtaaggatgtggtgtcactaaagctaacggatattcttccgtcacattacccgcaaactcttcaggttccatccaactaggatgccctttacaatcgttataattcattttctcaacaacatcagagaaaatttcaattttacctgacggtgtgccaagcggattgagcaatggntcttcacggaattcaccataacgcacccatttcttcgcagcttcacccgcctcaaaacttaatggtttattttctgcccagaatttgtcaaaacgtggcattgctacacgatttgcacgtgcagcactaaaggctgcattatagaattcttccagccactccatttcagttttaccttcagtgtattgttcttccacaccggcacgtttagcaagctcaacgaaaatatcgtagtcattttttgcttcaaattgtggtggaaccacttgtttcatcgggtaaacactcatcatagagtagtcgccagccatggttaagtcattacgttcataactcgtcgtagctggtaacacaatatctgccatgcgtgcagttggcgtccagttcacctcattgacaatcactacatcaggtttctggaaagctttcactaaggtattggtatcttgatggtgaacaaacgggttaccacctgcccaatataccgctttgatgtcaggataagtaatttcagtaccgttatactgaatctttttgcctggatggagtaacacatcagcaatacgcgctaatgggaacgcggatttagacgtatcatccaaccatgtttttgcccccgctttgcctgatggacttgctgtaattgagccgataataccgcctgtcgccgttggtaccccaccatttgaataatgataactcaagccaaagccgccacccggtaacccaatttgtcctaacatagatgcaagggttactaacatccagtgggtttgttcaccatggcgttggcgttgcatcccccagccacccattaacatggtacgtttactggcgaaatcagctgcaagttgcttaatggtttctgctggcacaccacaaattttagctgcccattccgctgtttttggttggccatcagttttacctaataaatattcttcgaatttagcgtaacctgacgtatattttttcaagaaatctttatcgtgcttgccttgttcaactaaagtatgtgcaataccaagcattaatggcacatccgttgctgtattcactggaatccattctgcattcaacatttggcaagtttcgcttttttgtgggtcgatacaaataatacgtttaccactcgcttggaatttcttgaaatattcaatccctttttggtcagtggacatccaagcaatacgcattgttgtgagtggatttgcagaccaaagcacaataatatcactactttctaatatggattcccagctggtttgttgttcgtacacctcaatcgtgcctaatacatgtggcataattacttgtgcagcccccgtagagtaatcccctttgtgtcccacaaaaccacctgtagcgttcatataacgctgtaataacgtacgagaagcatgtaatgaaccacaactaaaccaaccataagaaccggcaaaaatacctgttgatccatgttcgtcacgcacacgtttaagctgattgtgtactaaatctaacgcttcatcccaagaaacgcgcacccattcatcacgaccacgcattgtagtatcgctttttcctggattagctaaaaagcctttacgcaccattgggcatttcacgcgacgttcgctatacaattgatcggcaacaactgtttgcaattcgttcggcactgcaggctcaatagctggaccagatttcacgaccttaccatcttgtactacaaccccaatagatccccagtgagcggcagtcactaccgttttcatttcagcttcttttgcgaccgcactttttgatacaacgcccaccataccaccagaaagggcactaccagccacgcctaaagatgtttttttcagaaaatcacgacgttgttcatttacgttattctttttcatttcagcctcgttttagatagttaattcattcattattgttttgccatatctttggcattgcgttgcagataaatagttaatgcacgtacttcatcttttttcattgatgtacggtctttcatagaattcaccacaccaatccattggttagccgtgtaatgatctgcaccaattgctgcgtgacaaccactacattgagtttggtttaactgattaccgtattgattaagcgtggttaaatctgatgtcattttttcttttgcgacattcaccgcaacactgatttctttccaatcagaatctgttactgcatcatgaactatttttaatacttgaacatgattacgtgcatcttcgtccattaaagcaagcgtgatacgtttacctaattcttgatacacaactgcttcagcccccacttgttgccaaccatgtaaagtgccttgaatttgatcaccatccactttccattgcattaattctgcataaggcattaggcgaacctcatttcctttatcattggtcgcttttaccatttcagtggcaaaaatagctgagccatcagagagagtaccaccttgtactgcagaggatttttgtgtattttgatcgccatgcacttcaggtaggaagtgaacaatgcccttgtgacaatcaatacaagtttgaccgtttgtttgcgcctccgtatgagtttgttttgctaatttagtttgttttgaaagctccattgcatcaaaactgtgacagctacgacaggtttctgaatcattggctttcatatccttccacactcgttgtgccatttctgcacgatgagcttcatatttttctttattctcaatcttaccttgtgcttcataccacaagtcttttaaagcaataaatttagccttgacataatgccaaccttcttttggaatatgacaatctgaacattgtgctctaaccccttttgcattagcaaaatggctagaaccttcccactcctgttgtggataactcattgaatgacaactagcacaaaactctggtgtactcgttttgtgcattatccactgagaaccccataatgctcccaccccgacaccgactaaacaaagtgcggttactatttttttcatttttgacatagccactccaataaaataataaaaaacaaccctaactacttatagttagggttgattgtagaggttttgtaaatcaaaaactatgatatttctcaagaaaaaatgttataagctgaagaaaaacactatataaatcaataaataacgattagtatcaactttgcacatttagaaaatgattaacacttttaagtacatttcttcgaacattatctttttcaaataacacctcatgtttagcatttaatatgacttcacatctagcattcggaaaaagtgcggttaatttttcaagatttttgttatctactatttttctttttcggcttgtaaaattaggattggaatttcaatcttaggaataactttcggcaagcgtttaattgcgttcaaacacaaatgtacccaacggaatgttggcccgccaagattaattgctggatttttacgatttatacgattcatccatttcattctggttttacagaaagttaattcattgtattccaagtgggcttgttgataagcacctttgccaaaaacataacgctcgccttgtcctaaaatattcattagggtaataatcagttcatctctaatgggatgttttaaaagaataccgtaaaaaggcgaagaaagtaccgctttattaatgtgatgatcataatttgccaaataataggttgcaatcaatgcgcccattgaatgagcaagcaaatgctgcgttgaatagctgaaaagtgcggttactttttcgatgattttcgccatatcatcgacatagaaacgaaattcatctaaatgccctttttgaggaataatacgctgtgaatagccttgaccgcgatgatcaaatagcaatacatcgtaaccttgatgataaaaatcataagcgagctctgaccatttcagcatattttctgctcgaccatttactaaaatcatcaattttctgaccgcactttcaggttgaatcaaatgacgataagctaattttatatttcgtttaccagaaagatattgggtaggaaattgctcaaaaaaaggcaataattctgcaagagcaaattgatgaaaataaggttctctgatcataattttttaatgaaaagggcgtagtaaatacgccctttgtagtgaaagtaaaatttatgccactaattgttttaaaatacggcgaactggctctgccgcaccccataataattggtcgcccacggtaaaagctgccaaatattcaggccccatagccaatttacgtaaacgccccactggcacgcttaatgtacctgttactttcgctggcgttaattcacgcaatgtgatttctttgtcgtttggaatcacttttacccattcattatgtgatgcaataatttgttcgatttcttctaatggtaagtcttttttcagtttgatggtaaacgcttggctatggcaacgtaatgcaccgatacgcacacataaaccatcaacaggaattggattgtcgcttaaacctaaaattttattggtttctgcataacctttccattcttctttagtttgccctgtttcaggaagaagtttgtcaatccaagggattaagctaccacctaatgccgcgccaaagttatccgttgggaaattatcagcacgcatttttgcagtcactttacgttcaatatctaaaatagatgaagcagggtcttttaattcactcgaaactgcttgttctaataaacccatttgtgaaagtaattcacgcatattttttgcgccagcacctgaagccgcttgataagttgccacagaaatccattccaccaaatctttttcaaatagaccgccgatagccattaacattaagcttacggtacagttaccgcccacgaaagttttaatgccttttttcaaaccttcagaaatcacgtgttggtttactggatcaagcacgataattgcatcatctttcatacgcaacgcagaagcggcatcaacccaataaccatcccaacctgttgcttttaattttggatagacttcattggtgtaatcgccaccttggcaagtcacgataatgtctaattttttaagttcttcaatatcgaatgcacttttcaggtcgcctgcatccttgccaccaaaaacaggtgctttttgacctgcttgtgaagttgtaaaaaatacgggattaagattttcaaaatcattttcctgcgacatacgatccattaatacggaacccaccattccgcgccagccgataaagcctacatttttcattgttgtttccttagtttgttgtgcttgaatagcattattaattacaagatagcgttagnaaaatcaagtatttttaatgaaaattgatctttcgcgaaagaaattaaataaaaaagtgtggttaatttaaaagaaaatttaatttaatcactctttttctagttatctacttcaacacttattacgccatcttctgctttaagtaaagcatacgcatctttcaacattgtggaatcaatggaaaagcaacgaatttgtaaccgcacttctccactactttgatctttgacttgtatatgttcaatacgatactgattatttactaacaattgggtaactttccctatgctttccgcatcattgacaagaatattgaatttcgtccgacgacgttgtgatttacgatgaacccaacgttgaaccaacggacttaatcgaatagacaccaaaatcatcacagtggcgatgaccgcatcaaacacgaaacccgccccagcagcaataccgatccccgcagaagcccaaataatcgccgcagtggttaaacctgaaatcgcatcatttttcttatgcaaaatcacaccagcacctaaaaaaccgatgccactaatcacttgagccgcaagacgcattggatctgtacgaatattttctgaaacttgtgcataatgctctgcggcttgaattgaaacaatggttagcacacaagtggtaacggcaataatggcacaagtttttacacccacaggcttacgtttaagttcacgttctaagccaataacactgccaagcaccatcgctaatagcattttgctaaaaataattaagtgatcaggattgaaaagtgcggttaaaagtaaagatgaattttccataatgataaaaataagtccgacatactcgtctattctacatcacttagcttaaaatctttacctttccaagtctttaatttatcacctttcttgcgaaaattgagtagaatcttgcgtttgaaattttatagagcgaaagaatggttattttatgcaaaattcaaccccaagcattggctttgtaagccttggttgcccaaaaaacttggtagattctgaacgaatcttaacgaaataaacaaaaaatccatcttcgtattgaagatggatttttttattagccgaacactttttccaagtgtgcttggtagtctgctaagtattgttctacttgcggacttttaaccacatcgttacataagaatgtcggcaggcgagtcaaaccgaggaactcgttgagtttgtggaaatgcatatacaaaacatccacgcctttgccttcaaagaaatcgccttcgcgagtaaaggcttcaatcggtgcattccaagtcagtgaaagcatgtgtttttttccttgcaacaagccgcctgtgccatagccctcggttggattaacgctgtgtctgccatcactgtgatataacttgccgtgcccattggttaatacttcgtctatgtattttttcactgtccaaggctcatgcatccaccagctcggcatttgccaaatcacggcatccatccacaagaatttttcgatttcagcttcaacgtcataaccagcatcaattacagtttctttgacattgtgtccaagtgcggtcaaaacttctttcgcttttttgtgaagcgtgtggttcaactcgccgtgagaatgaccaaacgccttaccgccgtctaataataaaatattcatctttttgctcctaaaacaaataattataaaaaaaaatggggttgccattatgcctttttacgttaatttttaaaagtatatttgtctgccacgttatttctagactataaggaagattacagcccgtagggtgggaataaaccctagttaaacgcgtgggcttaagcccaccctacattggctacattagctggaattgaaaattcggtaaaaaattggtggaaatcgaacgaaaaatgaccgcacttttaaaataaaaaatcggcagaaaatttcttgccgatttttattaacttttcaaaatcgccctcaatctatcaagttggttttgtgttttttcttgtttttgctcggtggtaagttttggtttatcgcgttcccatagcacatcgtcattaggtaattcagctaaaaatcggcttggttctgggcgaactaattcgccatattgacgacgctcacgacataaggaaaaagtgagttctttttgcgctcttgtgatccccacataagccaagcggcgttcttcttccacgttgtcttcatcaatgctagtttggtgaggcaaaatgccctcctccataccaatcaaataaacataagggaattccaatcccttggatgcgtgtaatgtcatcagttgaacttgatcgctgtcatcatcgtcttcgcctcgctctaacatatcccgtaatgtcaggcgggttaccacttgattaaggttcatcggctcattggtttcatccccttttaacatatccgcaacccagtcaaatagcgtggcgacattcttactttgcatttctgccgctttagggcttgtcgcgtattcgtacaaatattcttcataatgaatcgcagataacatagaacgtaccgcacgttctggttcagaacgttgaatttcatcatyaagttctacaatccatcgaccaaatttttgcaatgaatcataggcttttggcgtgatgcgttgaataagctcaaactcaaaaatagcctcaaacaaactgatgtgtttttcttgagccaactcgccaagtttttgtaaggttgcggtgccaatttcacgcttcggtgtatttacaatacgcaggaatgctgcgtcatcatcttgatttaccaccaagcgtaaatacgccatcatatctttgatttctgcacgagagaaaaaagaagtaccgcccgaaattttgtaaggaatacggttttgcatcagtactttttcgagtaatcgggattgatgattgcctcgatacaaaatcgcataatctttatatttggttttacggctaaaacgatgggcgatcaactcggcgacaatccgctctgcttcgtgttcttcattttttgcttcgatgacaagcaatttttcccctttaccaatggttgaaaaaagtttcttatcaaacacgtgctcattgttatcaatcaaaatattggcacaatgcaaaatacgctgggttgaacggtaattttgctctagcttaatcacgttcaaacgagggaaatcatcgcgtaaacgcaccatattttctggtcgtgcgccacgccacgaataaatagattggtcatcatcgcccaccacagtgaaacaagcacgatcacccactaaaagtttaatcagttcatattgactggtattggtatcttgatattcatccaccaacaaataacgaatttttgcctgccattttgaccgcacttcttcattttgcttgaacaacaacgtcggaagcataatcaaatcatcaaaatcaagagcattgtaagttcgaatttgtgtggcgtaacgttacataacattttgcgaaagtttgatatttagcatcacgcgccaacgcaaacgcctgttttggcgaaatcaaatcattcttccagttagaaatcactgaaattaactcgcgcaataaatccttatcttcttttaacacatcagcggttagctcttttaacaacgcaaattgatcgtgctcatcaaacaaggtcatatttgatttaaagcccaacgctttatattcacgcttaagaatgtcaaaaccgagcgtatgaaaagtggaaacaagcaagcctttagattgttctttgccaatggaatgtgccacacgctctttcatctcgcgtgcggctttattggtaaaagtgacggcggcaatttgtttcggagaataaccgcacttttcaattaaatgggcgattttattaatgattacgcgagttttgccagagcctgcaccagcaagcacaagacaaggacctgtcacatattcaacggcttgttgttgttgaggattgagtttcataagaattattgagcccacgcatagggcagtaatacagtgtctaataaaaatgagagaggcaaatctaagattggcaatccccattgttgcgccatttcaagatcataagcaacccctgcataggcggtatatttttctgttggatcgataagtttgaccacggaaccacaaccagataaaacgataagtgcggttaaaaaaataaagatttttatcatcgtgcttttaacgcattgaacacaggcacaggaactagctcagcgacatcaccgccatgcaaataaatttcacgcacaatggtggaagaaacaaacgcccatttttctgctggtgggaaaaacagactgtctacgccttttgtgagtaaacgattaagggcagccaattgcagttcatattcaaaatctgttgttgtgcgtacgccacgaataatagcggaaatattgtgctgtttaatcacatttgccaacaaatcagaaaagccaaacacttccacattggataaatgcacaacagattgacgaacaagttctacgcgttcctccaaagaaaatagtggctttttacttgggctattcgccaccgccactaaaacacgaggaaaaattaccgcacttctttcaataatgtctaaatgaccgttcgtaatcggatcaaaagtaccaggataaatcacgctcgtcatacattgcgctccaaataaggttttaataaatctaacaaacgctgtaatgcccctcggttttccatcagcacttcatagccagcattacctaaacgttcgcgggattcttttgagtttaataaggcttctacggcgcgttctaaggcatctgcggttgaattaacttccaacacaccttgcacttctaccagcattcgaaatatctcgggaaaattgaaagtatgcttgccagtaatcactggcattttaaatgcaagaggttctaaaggattatgccccccgtgtttcacaaggcttccacccacaaaagcaatatcggaaatgccatacatcaacatcaattcgcccatactatcgcccaaaatcacttgggtattttcatttggtaattcatttgtggagcgacgaataaattgaaatttttcctttttaagtaaatcagccaccacattaaaacgctctggatggcgaggaacgagcaataacaataaatttgggtattttgctaacaaagcgcggtgagattttaaaatgatttcatcttctccattatgcgtgctggcagcaatccatattgggcgatcttgtttccaaagggtgcgcaatgaatcaattttacgtaatagttcatcattcgtattgagatcatatttaatattgcccgtgatattcaatttttcctttggatagcccaaagtggcatagcgttttccactaatgttatcctgcgctgcaatcaagctaatttgtgaccacattgtttgtaagtgcgcttttatttttccgtaacgatgcgcagaacgcgcagataaacgtgcattagcgataacaaatggaatattgcgtaaaaataattgatgaataagattaggccaaagttctgtttccatcacgatacataatttaggttgtacaaaattaataaaacgatggatcgaaaaaggtaaatcaagggggagataataatgaaaaacactatctccaaaagtggctttgacgcgctctgaacctgtgggcgtaaaagtcgtaaaagtaatggataaatgtggataatcttgttgcaattgacgaaccagcggtgtcgcagcaatcacttcccctacggaggctgcgtggataaagatcccttgtggtggtgggcaagacgcattgccataaaaaccataacgttcagccaaacgctgacgataacgtggagatttaacactgagcaagccaataaaacacaatatcaacggctggcaaattaaaagcaagctggtataaaaaaaacgccacataaatgaaattcggttatacttaaaaaaatttcggctagtatagcaaaaaaaggattgaaaatatgcctacaattagcgttgcaatgattataaaaaatgaagcacaagacctcgccaattgcttagataccgtaaaagattgggtggatgagattatcattttagattctggcagcacagataacactaaagaaattgcgctcagttatggggcgaaattctatgaaaatagcgactggcaaggatttggtaaacaacgccaattagcccaacaatatgtaaccagtgattatgtactctggttagatgctgacgaacgcgttacgcccaagttacaacaggctatcttaagtgcggttaaaaatgatcgagaaaataccgtttatgaaattccacgagtgagtgaagtatttgggcgtgaaattcgccattcaggctggtatcccgattatgtggttcgcctctatcgcacaaactatgcacaatataatgattcacttgtacatgaaaaagtggaatttccagctggcacaaaagtagaaaaattgacaggggatttagagcatttcacttataaaagcattcatcattatctagtgaaatccgcaggttatgccaaagcatgggcagaccaacgccaagctaaaggaaaaaaagccacactttggcaaggaatttcacacgcgcttggttgttttgtgaagatgtatttgttaaaagcgggttttttagatggcaaacaaggatttttattagcggtgttatcggcgcattcaacctttgtaaaatacgccgatttatgggagcgcgatcagcataaacactagctagttttgcaaggacaatcatttaaatgatcgtccaccagccccatagattgcataaacgcatagcacgtggtttcgccaataaagacgaaaccacgtttttttaaggctttagaaagtgctttcgatacttctgttttagttggcacagatcgcaaatcaggcacatcattgacgatcggtttatgatttacaaatgaccaaataaaatcactgaaattttcaccgcacttttccatcgccaaataagctttcgcatttttaacaatggcttctaacttggctcgatggcgaattaatcctgaattttgcatgcaagcatcaatatcaagtgcggtcatttttgcaatttttttcggatcaaattgatgaaaagcctcacggtaagattcacgttttttcaaaaccgtaatccacgaaagccccgcttgctgcccttccaaacaaattttttcaaatagcttttggctgtcgaattcaggctttccccattccttgtcatgataatcaatataaatagattgttcgccaacccaagggcatcgagtagtcataacatcgcctttttaagctgttcataaaccgagacaaaatctggcattacgcctcgccataaatggaaagaatgtgctgcttgtgcgactaacattccaaagccatcgctaacattggttaaacctaaacttttgcataatgcaataaatggcgtgtctgtgcctttcgcatattgcatatcataaaaagccgagcccaattttaaaatttcagcatcaactgaagccgttccaccacttaatccagcggaagttgcattaatcaccaaatcataagtttgtagcggaatcgaatccatagagacagcttgaatattgccgtaaggctgaaatctttcagctaattctttggttttcgaaaaagtgcggttagcaagcacaatgttttgttgagcttgtaaaagtggcaataatacgccttttgttgctccgcccgcccccaagattaatacgtgctgatttggacgaagccaatttaaacgttgtaaatccgtcactaagccaatcccatcagtgttatccgcataaagttttccatcatcgagtttttttagcgtattacaggcttccgccagttttgctcgttggctatattcgtctgccagctgataagcgcgttctttaaaaggcgaagtaatattgcaacctttcgcaccctcctcaaaaaatgccaaaagctgttgttcaaaagcatcaagatcgcctaattttgcaatgtattccatagtttgatgggtttgtgcggctaacttattttgaattaacggcgatttactttgcgcaatcggattgccccacacagcataaagatccataaattatccctgtctaaaaagttgattggtgcgcaagtctcgaatttccgatggattatgcgccctgcctaccatttcattcaatactggaaaatctgaaccgaattgtaaccgcacttcatcggcggtacggcaaggtggctctcctgttaggtttgcactcgttgaagttaatgcaaaacccgtgagttcacataaggctttcacagatgggtgatcgcacaaacgtattgcaatgctatcaaattttcctgtgagaaaatgcggggtggtggatttagctggcacaatccaagtcgttggacgttcatatttaccttgcaggcgagaaagctgttcatcgttaatctgctcaaaatcgacaaaaggacggaaaaaatctaagctaggagcgactaaaatcagccctttttccactggacgttgctttaaatcgagtaatttttttaccgcactttcactttgcggattacagcctaaaccaaatacagcttcagtgggataagcaaccacttgattttgtcgaagggcatcggcgatttgttctctattcatttcattcttttacttttattgctcaaaaatatgacggcaagttttatttgcacactggaaaatttgtttttccccatcttcgctttttaacaaagaaagaggaaaatggcacgttgggcaaggcacggaataaggcttggcaggcaaagaaaatttacatttagggaaattatcacagccgtaaaaaatctttccttggcgacctcgacgagaaatcaaatgtcccgttttacattcaggacaagtaattttttcctcagattcagattcttcccgcaccacaaaatcgcattcaggataatgactacaaccaataaacatcccaaaactgccttgtttcaactgcaataaattaccgcacttcgggcaaatttcatcaagtgtttttaatactttatgctccgatcgttgcaaaggacgcaaataatcacattcaggataagcagagcaacctagaaacagcccttttttgccttgtttaatttgcaacggcgcaccacattgagggcaatattcctgttgtttgctatgatgaaaaaggctttgattcataatctatccttatgcttgaagcatttcttccaattcttcctgtgcagtcatccattccgtttctacatcatctaatgctttcttcacatccacttgttgagccaaaagtgcggtcaatttttctttattttcggcattatataattcggtatctgccagttgattttctatgttcgcaagctcagaagaaaatttattcattttttcttctaattgcgtgatttttttacgtaatggtgcagtttgttggcgtaactctgcttcacggcgtttttgttccttgcgattttgaaccgaattttcattatcgcccactttttccgaaactttattttcagacgtactgttttgttcactcagccatttttgatagtcttctaaatcgcctttaaattcttccacttttttatcgtgaactaaataaaattcttccacggtattgcgtaataaatgacgatcgtgcgacaccaccaccaaagaaccttcgtaatccaccaatgcttccgttaatgcttgacgcatatccaaatccaaatggttagtcggttcatcaagtagtaacaaattcgggcgttgccaaacaatcaaagccaacaccaaacgagctttttctcctccagaaaaagatttcactgcttgatttactttatcgccgtgaaacgcaaaactgcctaaataatcccgaacttgttgctccgtttgctcaggcgcgagtttttgcatatgccacagagcagattcgtctgcgcgtaaagtatctaattgatgctgagcaaaataaccaagttgaacacctttagctaattgtaccgtgcctgaaagtgcggtcagttctcccgctaaaagtttaatcagtgttgattttcctgcaccatttttcccgagtaaaccaatgcgcgaacctggcactaaattcagtttaattttacttaaaatttctaccgcactttcgccgatgccataacctgcactcgcttgctcaatcatcactaagggattcggcaaggattgcggtggacgaaattcaaaagtaaaaggattatccacataagcaggtgcaatcagctccattctttctagtgctttcatacggctttgtgcctgtttggctttagtggctttggctttaaagcgatcaatatatttttgtaaatgggaaatcttttgttgttgctgacgatacatcgctgtttgttgagccagtttagtggctcgttgcacttcaaaggaagaataatcgcccgtgtattcgttgagcttctgattttcgatatggaggatttttgtcacaattggatcaagaaaatcacgatcgtgagaaattaatactaaagtgccttgatattgcactaaccatcgttccaaccaaataaccgcatccaaatccaaatggttcgtcggttcatccagtaataataaatctgacggacaaagcaatgcctgtgccaaattcaaacgcatccgccaaccgcccgaaaaggctttcactggctgtattgtttcttcttggctaaatcctaaaccatgcaataaagacgcggcacgcgattgaattgtccacgcatccaaggtttctaattgcccgtgaatgcgtgcaatggcgttaccgtcattgcgttcatttgcacgttcaagcttttgttgcaaacggcaatattcacgatccccttgaatcacataatcaatcgcagaaatatccaatgcaggcgtttcttgatttacccaagatacccgccaatttgctggataattcacctcaccgccctctggcattaattctttttttaataaggcaaaaagcgaagattttccacaaccatttttccccaccaaaccgactttttgcttgggattaatcgtagcagacgcattttcgagaagttccgtttgccctcgttttaaggataagttactaaatataatcatttttctacataggtcttaatttgaggctattttgcaatattttttcttttctcggaacagtctattccgattttatcgattttctagtcaaaaaagccacgtataataagacgcaataaaaactatttataatataacaagtcaatatrrcgggtatatcttaggcattttttacccttagaggaacaatcgacagggttttccctaaaggagcgagcaattttaacaacgtttcaagctgaggattcgtttgtcctttttcaatgcgtgcaatcataggttgcttcacaccgcttaaggtttcaagttgtttttgggaaatcccaagttgctggcgagaagtaatcaattctttaattaaggctacacgcaaattactttctcggatttcttcttcattgaaaatttgctgttcaaactcattccaatttgaacctaatgggctgattttattcatttttcaatctctcttttaattcacttaagcgttgttgggctgtttggatttctcgttttggcgttttttgtgttttcttcataaattgatgtagtaagacaaagcgaccatccattaatcttgcaaacaagatgcgatccctaattggacgaagttcccaaatttcaccgtctaaatgtttcacatagggtttgccaacagacgtcccgagttcgcttaataactttacataatctcgaattttattcagtttaattcgactatctttgctttcattttgagccagagatagcagatactctttcactggctcaatgtcattttggtctctgtaaaagagaatctcgtacataatttatcctatttatctacttatttcaataaccaataagttattgatttttgatgtgtaatcataaatagaaactaaaaatttggcgagatagtcatttcaatctttcgatctagatcgcaaaaatagcgaaaatagcttgattttcaaggagattttgcacaaatgccgatgtttgaacattggctttgaaagagagagtaaaagatagatcctttcttaagaaaaagtgcggtaaaaatttaccgcacttttgattttagataggtttaaaattcaaactgaactgacattttataatttctacctggtgcgtagaagcggttaatgcctaatcctgttgattgatctataacattacttgttccaaatgaacgaattgaacgagcagaatcccaagtaatgtatttacggtttgtaagattatatacaccagctcttatggttaaatttttaattggttgtacatatccaattaaatctagaatagtataagatttgcttctccatttaattgtgctgtcttttttattttcttctttatagaacatattataagtatcttctggatttttacttgctacatgtgtcgtatagaaatcgaaaccaaatttatgatttggatgatcatatcctaaaccatataccatagttctaggctgaattgcattcataggaatattgccattcattctgcctttttgataggtatatttatagcttaggttaaatccatccataaattttgccattttaccaaggaatacttttgaattaatttcaataccttttaaagacgcattatctctatttatattttgataaagagaaaatggtaatgtttcacctcttccagagccgcctactttaaaagtttcttgctttttaaatattaggtcaataaagtttttatagttagttttaaacagacttgtcgagataaatccccaatcatcattatgtaatgtgaaagcaatttctttggtttttgctatttctggttttaaatcagtatttggcaaaatagtgaaatcagggtgtttaaaggtgaaatacatttcatctgaagttggtgttctaaaacctttagaatattttagttgtaaacgaagaaaactcgttggatcaatggttgaaacaaaactataagaatgtgctttatattttttgttctgtttggcgatatagtcaatattttgttgtacattttccttaactttattaggatctgaatttgaattgtttggtaatggaataaataatcctttcacaatatcatcgggtaatttgggtgtgataccgtgtttatattttggttgataatggatattgtcataacgataacccaaatcaaaagataaataatcagttataacaaaattatcaaagagatagactgattttcctgttgttttaatgggtaataagtaagaaaattcaggatcaactcgaggacaaaggttagcattccactcataagtcgttgcacaagtgtgaggttttccagtccaagaatcctcaccaagcgtaggtgttgcccaccattgcacatcagaagcatcgttgccagcacgattaaccatgcgcttcatcgcggtattatatgatccaccatattgtagattatgttcaatatgccaaattttgaagtctttggttaaatctaaatttaattgttgggtgttggtgtccaaatctctctcttgccagaggcgttctaaataaccaggtgaagagggaagaatagattttattttcctatcattatcctttattttagcgaattttttgccatttaattcttttatttcaaggtcaacttctttccattttccatcatagccataataattgttacctttaaaaacttttatttttgcgttattttcacaattaaatattgaacaatcataccaagtgtcagaggggttgtttaggactagtttatcgtctattactctcttatcagtatcaataaatttcttgaagtcataggttttatcactactcttagctgtattgtttttttcctcaaattgaaggtctgaaccatctcgacgtgttattttcccatttgttacttttagtcccgtaggattgtctgtgccttcacaatgtcttacaccagcatcacaatactcatctgtgcgtgcacgagttttaatacgttgatcagaataagtgagttttagcgtatcccaaaatggagtttgagagaaattttcataactaaatgaaatattacgtctctttgttttatcattggtgtgtctagaatcaacttcaggggtttcattaccactacgttgatattttaatgtataggataaatcttgcccacgagaacgatgttcatataaatcagcggcaaaggtaaaacgatgattttctgtaggattgaaagataattttaataatgtactatcttgttcaattttatatggatctgctttttctctttttttaccttgaattttatcgttataatttttataaccatagttctcaagttcatgcccatttctgcttgttgtaaccactagcacatcgaactttttataacgtcctgcaagagtaagggtatcgaatgattgattattttccgtagcgtatccctttttgtaacttacatagtaatccttgtttatgagataatctctcgcatcttttgttttataaattacagaaccacctaaggaaccactaccattcttaatagaatcagccccttttgtgatatttacttcttttaaggtttcaatttctgcaccattacgcgtgttattgaaattaccataaccttcaaaaagctctttaaagccttgagaagataaggtttcagcttgacgtaatccatcaatattaatcgctacacgattttcatctacaccacgaatggcaaaaccgctttgcccaaaacgtccagcttcaacaacagtaacgcccgtttcgtatttaacgatgtctttaatgttgtttgcttgttctctttccagcgttttagctgtttttaccgtttcagcaatttttggtggtgtttttgtatcactattttcggtagaaccagatacatttatttgttctagttgttcagaaacattactattttggttggttggttggttggttggttggttggttggttggttggttggttggttggttggttggttggttggttggttggttgagctgcataagcaacacytgccgttagcccaagcataacggaataggcaagcacgtttaatctaaaattggtcatatttaatcccataaaaaaaataataataattctcaaacatattataggagaaagtattctctcacaatactaaaagtgtatttttgatcaaaatcaagaaataaaaactattctcattatttgctgtatttaaacgtgcttgtttcctataatgcgagccgttgattgttgatattagtaattgtagggtgggcttcagcccaccatcaaacaatcgtaagatattttngtgggctgaagcccaccctacattaagtacgcataattctttctatgcgtacttctttttattttaggagtaatcattatgatgatagataaacgcctaattaacacggtggctgacagcaaaaaatggattggtatcacggtgttgtggaattgggtggcgttagtagttgtagggtgggcttcagcccaccnacaaacagtcgtgagatattttggtgggctgaagcccactctacgttaagtacgcataattctatgcatacttctttttattttaggagtaatcattatgatgatagataaacgcctaattaacacggtggctgacagcaaaaaatggattggtgtcacggtgttgtggaattgggtggcgttagttggtgggattattagtgccgtcgtgttttcttatattttacaggcggcttattttcacgaattaagcctgttaagtgcggtcattttgggcatcgttttgattgcagcattggcattacgtgcgtttgcagggaaaaaatcggtgcaggcgtcttattttgccagtacaaaagtgaagcatgaattgcgtagccttatctatcgtaaattggcttctatgccgcttaaccaagtgaatcaacaatccacctcaagcattattcaagtggcatcagaaggtgtagaacagcttgaaatctattttgggcgttatttgccgcagcttttttatagcttgcttgcaccgcttaccctctttgctttcttgatctttttcagttttaaaacagccattattttattaatttgcgtgccgcttatcccaatgtcgattatcgcggtaaataaaattgcgaaaaaacttttggcaaaatattggtcgatttatgtgggattaggcagtagctttttagataacttacagggtttgattacgttaaaaatctatcaagatgatgcttataaagcgaaagcgatggataaagaggctgagcatttccgcaaaatcaccatgaaagtgcttactatgcagcttaactcggtttcactgatggatttactcgcttacggtggcgcagctatcgggattttaaccgcactattgcaattccaaaatgcacaactcagcgtgttaggcgtgattttatttattctcctttcctccgagttctttattccgcttcgtttgcttggttcattcttccatgtggcgatgaatggcaaagcggcttcagataagattttcacattgttagatacgccagtggaaacccaacaaagtgcggtggattttgaagcaaaaaataacgttcaagtggaaattaaagatctgcatttttcttatagtgaagaaaaaccagcaattacaggtttaaatttgagtatcttaccaaaccaactttctgtatttgtgggtaaaagtggttgcggtaaatcaactttagtttcgttgttgatgggctttaataaagcgcaacaaggtgagattttgtttaatggacaaaacgccctcaatattgaccgcacttctttctatcaaaaagtatcgttggtgagccatagcagttatgtgtttaaaggtacgctgcgtgaaaatatgacgatggcgaaaattgatgctacagatgaacaaatttatgcgtgtttagaacaagtcaatcttgcccaattcgttcgtgataatggcggattagatatgcaactattaagccgaggcgcgaatttatcgggcggtcaaattcaacgtttagccttagcgcgtgctttactacacaatgccgagctttatatttttgatgaagcgaccagtaatattgatgtggaaagcgaagaaattattttgcagttcattcaacaatttaaacaacaaaaaaccattgtgatgatttctcaccgcttggcaaatgcggtaaatgcggattgtattaacgtacttgaccaaggcaaattgattgagcaaggcacacataaagagctaatggaaaaacaaggtgcgtatgctgaaatgttccaacaacaaaaagatttagaacaaattagagaggtggcaaatgcgtaaaaatggttttgttgtaatggggcatttgttgaaattagtgactccacttgcgcacattatggcgtttaccattactatgggtacgctcggtttccttgctgccatctttattatggtgctgggtgcgacggggttagtgaatcttttaaactttgatactcatttaagtttctctggcattttgaccgcacttattgtattggcggtggctcgtggtgcattgcgttatttagagcaaatgtcagggcattatatcgcctttaaattactggcattattgcgtgacaaagtgttttcttctttacgccgtttggcttttgtgaagttgcaagataaacaagctgggcaattagtgtctttagtgactaatgatattgaattactcgaagttttttatgcgcataccatcgcaccaattatgatcgcattctttacctctgcgattttattgttggtctttgcccagctttcaagctggtttgtgcttgtggcattggctgcgtatttaacagtaggcgtgattttaccgattatcaccaccaaattggcacgtgaagatggcagacgttatcgtgaattagtaggggaaatgaatgacttcttcctcgacagcgtgcgtggtatgaaagaaattcagcttttcggttatgcaaaacaacgtttagatgaaattcaacaacgcagccaaaaaatcgatacggcgtttgagcgcattaaagaccaagaagcgaaagttcgtgtttatactgaagtggcagtatctgttttcaacattattatgctgtttactggcttaattttatttagcttagataaaattgatttcgctgcctttttaatcggcgtgattttattgatgtcgagctacgggccagttatcgccttaagtaacctttcaagcaacttattacaaaccttggcttctggcgaacgagtattaagtttattagcggaagagccagagttaaaagatgtagaaagtgcggtagatttaaaagatgtttctcgcattgatgtcgagaatgtaaacttcgcttacggcgaagaacaaattttatcggatgtcagcttatctgtgaaaaaaggggaaatattaggtattcacggtagaagcggcagcggtaaaagtaccttgttaaaactgcttatgcgtttttacgatccaaaatcaggtagcattaaaattaacggcgaaaccttaccgaatatcaacacttgcagtttgcgtgacaatatggcgtacattactcagcaaacctatattttcaacgaaaccattgaagaaaatattcgcctcgcacgccgtgatgcaaccttagaagaaattatggaagcggcgaagaaagcctcaattcatgattttattttgagtttgccacaaggttatcaaacaaaaatgaccgaattgggtggcaatctctctgacggagaaaaacaacgtatcggtattgcacgagcatttttacacaatgcaccgattatcttgcttgatgagccaaccagtaatttggatagcttaaacgaagcaatgattttgaaatcattactcaatgtgaaagctgaaaaattgattattctcgtcagccaccgccaatctaccatggcaatttgtgatcaggtaattggcatagaaaacggcagaatgtcctaaattaatataagaaaaaatcgcactgttaaaggtgcgatttttttgttagaggaaaaaagtgcggtgaaaattccctttggattttatagttcaggttcatttaataggttaagcaaagctaaacgcttgcgataagttttcagcacgcaatcaatatgtggctgcggcataaaggattgtgaataaatctgctctactttttccttttcttgtataatttcaggaattaatttttgaataatcacatttttatttaatccaatattttccccaaactcgacaaaatcatcgccgatatattcaccgtattgagtattaaatcctttggctagtgtggcattaccttcttctcgcgctaacaatggcaaagcaagtagtgttgaattaaatatttcaggatagggcgacactgacacaaaatcataaattggagcaagttttggatgactgtttttgggataaataaatgaaaaattgcgtaagtgaagatcattatttcctaataaataagcgtaaataattcgacgaaaaatttctcgttgctgagctaaatgattttctgtgtgctgcaaaataaacttagcaatttgttcataacttacatattgctcattatctgcacctatttttccatacttgtctcgaatattcattgcaccatcaagttgttcttggtgcattggtttttgctgtttatcacgatcaaaacgcgttataacaaaagcaaattctttatgattttgttcgccagcaaaagaaactaaaccattttctggcacatcaaaccctaattctttcataatgcgcatggtggcgtgttcattttcagctaaaaaaggatactcttctggagagggctttaaaatataatttccctgttgatttacgctgtcaaagtgctcatctttgataataagctgtaattttggttgaaaacctgaaatgctcattccttgctgtttttggggtttcactgtaataaattcttggcgagaaaagggtaattcaggattaaaatgtttattgtctgtaaggtaatgcaaaccttcagcactgtaacctgaaagtgcttcatttttcttcaatggctttaataaaatacgacaaaaattcattgtttttcttcctgaatttgcactgcgcctaacatattttccccgttattaagtaaaaagcgaaacatatcgctttcatcaattcgttgatgaagtgcatatttgtgttttagccagccttctgggacgagcgatgcaaaataagggaataaggtgtcagaatgaaaaggactttgctcaataggaaagctgagagagagcggtattccttgataatcggggttgtaagaaaaatgaaaaccacgatgatcttctctaagtaagccaataaattcgccgtagagaaatacttttcccgagcggactaaatcgcgcatagtgaaacccctaatgtttgagcaacaagaaacacggttgtaaatctcacttggcttggatcttgaaataatcggttcaaggtagaaatagacacgccagtttgcagttctagcatactaagctcaataccaagtgatttacgcttatcattgagcatttttccaaatgctttgagatcggtaattttccctgcgtaaagttgttgtctttgcgcttgctcataggtaatgactgatttctgaagcttttttaattcatcaatttgattttctaattgtgcactaagattgtccatatttgatattttttnctttttatggaaatattttatatcatatatgattttttgtttttagaatatcttttttgattttttttagggaaaaatttgaggaattattcaaaaatgatacttaaaatctgctctgtccatttgtaatttgtcccattttttggagagcagattaaattaattgaaatgttgtttgcttgagctaaatattcaaaattttataaaggtcatccaaataatgaatggattgaattttacgaattgtgcgggattttcctcgaattaaaatggtttcagtactggctaaattgcctttgcgggagatacctttaagcaaatcgccattggtaatgcctgttgcagtaaatacaagattgtcatcacgcacgagatcttcaagttttaacacttcattcacttttacgcccagtgctgcacagcgttgaatctcattagctgcaatttttttattttcttcggtgtcgctttttacttcattgcgtgggattaaacgagcttgcatatcaccacctaatgctcgaatggctgcagcagctgccacgccttctggcgcaccaccaattccataaagaagatcgacttcagcatcaggtaagcagcaaagcacagaacctgccacatcgccatcaggaattgccaatactttcgcgcccaagttatgtatttgtttaattacagcatcgtgacgtggttttgctaataccattacggtaaggtcagaaagggattttcctagcttagatgcgatgcggcgaagattttgttccagtggtaaatttaaatcaatgatgccttttacatttgaacccaccactaatttttccatatacatatcaggtgcttttaaaaaggtatttttgccacctgcagccaagacagaaatggcattagattgccccattgcggtcatatgtgtaccatcaataggatctactgcgatagaaactaattcccctaagccagaaccgactttttcgccaacataaagcattggggcttcatcaatttcgccctctcctataacgatttcagcgtccatatgaattaaattcagcatataacgcatcgcttttaccgctgcatcgtctgccgcatttttatctcctcgaccaagccacgtgtaagctgctagagcggcggcttctgttactcgtgaaaattcaatggctaatgctcgattcattattattctccttctgcttatttttcaagattatggtaaaaatagcatcattctatcactgagtaatcgtttgcataataaatttttattcaatgctttaaaaaggtaaatttactgggtaaaatacccctaaacttacccatatttaaaaggaaatcattatgtctttagaaattttagaccagcttgaagaaaaaattaaacaagcggtagaaactatccaattacttcaattagaagttgaagaattaaaagagaaaaacgcagaatctcaaagaaatatcgaaaacttacaaactgaaaatgaacagctgaaaaacgaacatcgtaattggcaagagcatattcgttcattacttggtaagtttgataacgtttaatcgtagtaaaaggcttagattttctaagcctttttattttaatcatttgaataattttcttttctctttgagaaaaaataaatataggataataaaatgcacatttgcattctttcaggcagcactttaggtggtgcggaatatgttgccgagcatttaaacgatgttttagaaactcaaggtttctccaccgcactttttcacggaccaaatttatctgacattgaaaacgagaaaatttggcttgttgtgacttcaacgcatggtgcaggcgaattgccagacaatttaaaacctctatttgatgaattagcgaatagccaaaaggatttttcagatgttcgctttgcggtcgttggattaggtagttctgattatgatactttttgctatgcagcggacaaagtggagcaaacacttcaagcaaaaagtgcggtaaaaatttgtgagactttaaaaattgacgtgttaaacgtggatgatcaagaaagttatgctgaagaatggttgccgagttttattgagggattgaaatgatcgccctaattcagcgtgtgtctcaagcaaaagtggatgtaaagggcgaaacaatagggaaaattggcaaaggtttgttagttttgcttggtgtagaaaaagaagataaccgagaaaaagcggataaactcgctgaaaaagtgcttaattatcgaattttcagtgatgaaaatgacaagatgaatttaaatgttcaacaagcacagggggaattacttatcgtttcgcaatttacattagcagcggatacgcaaaaaggtttacgcccgagtttttcaaaaggtgcgtccccagcattggctaatgattatatgaatactttatccaaaagtgcgcagagaaattacctgtttcaacagggcaatttgcagcggatatgcaagtgagcttaacaaatgatgggcctgtgacgttttggttaaatgtataataagaaaatctaagttggcaataagctcactgttttacatttgttttattaaatggtttagttaatggaatattctcgttaaagcgtataaattccatcaattaataatgaaccatatattcggttggtaagcaaaaaggcggactgaagccctccattgctccctcacccataaatgggcgtttcctttcaccaatggtcacttaataataacgagcaatcgcttattattttactaataaaaatgcgatgaaattcttttcaaattgcaccgcacttttaagaatataagaatagtaaattattgtcggattaaaagagcaacggcttcacaagcaatcccctcttgtcttcctgtaaagcctaatttttcggtagtcgttgcttttacattaacttgctcaatatcgcattggagatcttcagctattttggcacgcattgcatcaatatgtgggcgcattttaggtgcttgagcgatgatggtaatatcaacattacctattttatatcccttttcttgtacttgacgaaacgcttcacgcagtaagcctcgactatccgcatttttatattgcatatcagtatcggggaaaagttttccaatatcgcctaaagccgcagcccctaagattgcatcagttaatgcgtgtaatgccacatcgccatctgagtgcgcaataaagcccgtatgataaggcacttctacaccaccaataattaatggacgatcttcgccaaaagcgtgaacatcaaagccgtgtccaattctgatcataatttattccttgttaaataaaattctgctaatgctaaatcttcaggacgagtgacttttaaattatcgctacgtccagccactaagtgcggtcgaaatccagcaagttctattgctgatgcttcatctgttatattcgcaccttgttgaattcctgtggaaagcgcatctcttaatatatctactgggaaaaactgcggtgtcattgcttgccaaagctggctacgatcttctgtttttacaatacattgctgattgtccgctcgtttaatcgtatctgttactgggattgccaaaatcgcaccttgtttatcttcaatagctaacaatttatcaatatcagcatgttgtaaacaagggcgagcagcatcatgnacaagcacccaggcatttttttccgcaattgcatttaaaccatttaagaccgattcagctcgcgttgtgccaccttccactaactgaattttaggatcgagcgatagtgtagaaatataaggatcatctttgcttaccgccaagataattttagatacggcaggataagaaagcatcacatcgagtgtatgttcaagcagtgttttgccaagcagcgttaaatattgtttcggtttatccgcttgcattcgtgaaccaacaccagcagctggcaagaccgcaataattgaacgagccattatttactctcttttacaatatgatagaacacttcattttctttcactaagccatgttgcattcgtgcgcgttcttcgatcgcttcaaaaccttttgttaatccttgaatttctgcattaatacgctgattacgttgagatagcttttcattttctgcttgattttccttaattttctcagcattttgacgataatctaaaaaaccgttactgccaaaccaaaaattatattgaaacaatactaatacagaaagaaggattaaaataagaagtcgcatacggatatttattgtgagtaaaattttaacctgtttaccgtgaaaaattaggaaaaacgataaaatgaaagaaagtgcggttaaaaattcttttattttaaccgcacttttttgtataaaaattattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatggcacgcgctgtattacccgtatcaactaaatcatctaccacgataaatccttcgccgccatttggcacttgggctgcatgaagaacttgtagttctccctgattattgtgatcgtgataacttgcgatacaaacggtttcaatatgacgaagacccaattctctagccaatacagccgctggaaacaaaccgccgcgactcaccgcaataatacctttccattgggaagctggaagtaaacgttctgataatctgcgagcatgcatttgaaacatatcccaagtcaccacatatttttcgctcataattgcaccttagtttaaatttatcgagaaataaaaaattgcgtaaggataacccgaaatggcgttttatgctattatttcgtcaatattttcagtaaaaaggagcaattatgtctgaaattacaacacttcaaccttcactgttatggaaatggttcgatcaaatttgtgcaatccctcatccttctcattatgaagatacgttagctaactttattgtaaattgggcaaaagaaaagcatttttttgttgaacgcgatgaagtaggtaatgtcctcattcgtaaacctgcaacaaaaggaatggaaaatcacacgcctgttgtgctacaagcccatctagatatggtgccacaggctaatgaaggcaatccacatgattttaccaaagatccaattcaaccttatatcgatggagaatgggtgaaagcacgaggtaccacactagggtctgacaatggtatcggtttagcctctactttagcggtgttagaaagcaatgatttagcccatccacctcttgaagtgcttttaacaatgacagaagaaacaggcatggatggcgcaaaaggcttacgtcataactggttacaatctgaaattttaatcaatacagataccgaagaaattggcgaaatttacattggttgtgcgggcgggattaacgcaaactttgaaattcccgttcaatatgaaactaatacgtttgagcacagtgcacaaatcacccttaaaggtttacgtggcggccactctggcggtgatatccatacagggcgcgcaaatgcaattaaagtgttagcgcgagtattagcaaaactctctcaaaatcaaccgcactttgctctctctgaaattcgtggtggctcaattcgtaatgcaattcctcgagaagcagcagctgtgttagcctttaatggcgatgtaaaaaccatagaaagtgcggtagaaaatctcgcggttgtgcttaaagaagaattagcaattgcagaacctaatttcacactttttgtagaatccgcagaaaaagcccctaccgtattcaccgcacaaagtactcaaacggttattaacgcactcaacgtattgccaaacggcgtaatccgcaatagtgatgtagttaaaaatgtcgtagaaagttcattaagcgttggcgtattgaaaacagaaggtaatgttgtaaaaagcaccattttagttcgttcattaattgaaagcggtaaatattacgtaactgaaatgcttagctcacttgcaatcttagcaaatgcaaaagtcgagttttctgcaccttatccaggctggcaacctgtaaatgactctactatcttagacgttactcgcaaacattatgctgaagtgctaggcgagcaacctgtagtgaaagtcattcacgcaggattagaatgtggtcttttaaaagaacattatccaaacattgaaatgatttctgttgggccaacaatacgaaatgctcactcaccagatgaaaaagtggaaatcgcaacagtacaaacctattgggatttattgacaagagtacttgccgatattcctgcgaagtaatctaatattaattaaaagtgcggttaaaatttcttttgttttaaccgctcctttatttttttcgtttcgctcttgggtgcgcctgatcgtacacttctgccagatgttggaaatttaagtgagtataaatttgtgtggtggaaaggttgctatgcccaagcaattcttgcacggcgcgtaaatcagaactggcttccaacatatgcgtcgcaaaagaatgacgtaatttgtgcggattaagatggctatttaagccttgacgaataccccaagtttctaaacgtttttgaatagctcgatgagaaatgcgatttccaagctggctaacaaataatgcctcatcttttgggttaaataatgcccgcacttttaaccattcttgaatggcatgcgaagcgtaacgcccaaacggcacaactcgttctttgttaccttttccaataacgcgtacttcccgcacacgggtattaatgctgtttaaatctaagccttgtaattcagataaacgcaaacctgaactatacattaattccaaaatagcacgatcacgaatatcaattggctctttgctatcgttggcaagcaattgttgaacttgctcgccatccatatttttcggtaaatgcctgccttgtttcggtgcagaaatgcctgtggcaggatttacttttaattcgccttgttgcactaaaaaactgagaaatcgacgcaatgcagataaacgcaaagccaagcttttttcttttaagccttgttttttgctttccgctaaaataaagcgcaccacgctaggcgtcacttgtgtccaagaatgaatatcttgttgcgctaagattttgatggtggcatcaagctgatgttgataattagtgattgtgtgaggactcatttggcgttcaatccgcaaataatcccaataacgatttaacgctgttagcatgacaaactcaattcaaataaacgttcttttgggttcaatttaaacccttccgattccaacattgaatattgattttgcgctaattctgccactaaacgattggattgcgtgaaatgcacaaagtcttttgctttagaaatcaacgccgcataaatttctgtttgttgagcatgttccaacacaaaaatatcggtgatttgccaatagcgttgtaattgtaaagaagaaaggcgagggaaaagctgcacaaagccaatagccttttcattttcatccaccgcaataaaaaacaggctttcattaaaacgcatacgattagttaaaaaagctaaggtacgttctggattctctgcttgcccataggcttggcgataggcttcaaaaagaggaagaagcacttcaatattccattgttcagctttgaaaagtttcataattggttattttttattggttccatacaggtaattgtagctttttagctcaagataatcatctttctgtgagaatttttttaattttatgatcttctgcaaagaataggggcgaaattttggtatagtaagcaagttaattttatcaactatggagaaacaaaaatggcacgtcgtcctttagttatgggtaactggaaattaaacggtagcaaagcattcacgaaagaattaatcgagggattaaaagcggaattacatgatgtaacaggttgtgatgtagcaattgcccctcccgttatgtatttaggtacggctgaagcagcactttctggttgtggttgcagctgtggcggtaaaagtgtgattcaattaggtgcacaaaacgtagatatcaatgtgaaaggtgcatttactggtgatatttcaactgaaatgttaaaagatttcggcgcaaaatatatcattattggtcactctgaacgccgcacttatcataaagaaagcgacgaatttgtggcgaaaaaatttggtgcattaaaagaagcaggtttagtgccagtattatgtatcggagaatctgaagcagaaaacgaagcaggcaaaacagaagaagtatgtgcgcgtcaaattgatgcagtcatcaatgcattaggcgtagaagcattcaacggtgcagtgatcgcatatgaaccaatctgggcaattggcacgggtaaatctgcaactccagcacaagcgcaagcagttcacgcatttatccgtggtcacatcgcagcgaaatcacaagccgtggcagagcaagtaattattcaatacggcggttctgtaaatgatgcaaatgccgctgaattatttactcagccagacatcgatggcgcattagtgggtggcgcatcattaaaagcccctgcatttgcagtaattgttaaagcagcagctgcagcgaaaaactaattttcagttaattagaataacaacaaaagtgcggtaaatttttaccgcactttttttatatcttatatttttgatgaatgggttagtaagtggtatcaatcggcaattctgctctgcaccatccatcaaatccgccaatcatactaaatacatttttatagccttgttccacgagaaaagtcgctacatttcgactgctcacgccgtgataacaactcacaataataggcgaatcaaaatctgctagttcttcaaattgcaaaaaactttggtttgttaaatgaaaagcacctttaggatgtgaataagcaaagcgcatattatctcgaatatcgactaatattgcgccttgttgcatcatttcccaagcttgctgtggagttatttctttaaatggcatttataaacttccttttgcgtgtgtttgtaaacgccatcaaccataacaagaatcatcgcgatgactaaacaaataaaaagtgggtagctttcgctatcaatttgttctccgatcaaaaatgatacgcatagcatcataatagtttcaacataaccaagcagaccgagtaaattcataggaagcatattactggctattacataggcaattaacgcagtaccgctgattaatcctagtaatacaagcrgcccccaaataaacggattggtttgttgtactgtcgcgaaatctgtttgtaaagcaaaataaatactgacaggcataaggcttaacatttctaaacaaaaggaggcaagatcggtattttttaatgcttttcggatagaaaaatatgcggtgtaacctaaacagataacaatggcttcccaagaaagaccaccttttagcacaatattagaaattacgcctaatgttgcaatgataactgcaataaatttgaatgttgaaatgcgttctttaaaaaacacgcgacctgccgccaccattacaattggtaaaagtaaataaccaaaagatacacttaatgaactgccattattcggtgcccaaagaaaaagccacatttgaaaacccattaataatccgcaaagtaaatatgacaatgctaagtgcggtcgtttttgaatgcgttttaaacgttcaattaaagccgctttttgtttaaataatgtgacggacaacaggacaaaaggaaaagtaaatatcatccgataaccgaaaatatccgtgccactcaaaggttttagtaacgtagaaaaataatacatatagccaaataaaaacgaggctaataatgaaacgagaatacctttaaacataagaaatccttattttaaaccattatttattctattctaacatcgcccaaaatgcacggactaggggctgttcgagatttcttttttgggtgcaaatacctaattcaaaaggctcaataggtttatcaagattaagtctggaaatttggttattcattgggctgctgtcaattactgcatcaggcaacattgctaatccaaatcctaatcccaccattggcacaattccttcgtgtcccgcaacagtagcataaattttcgggtgtttaatttgtttctcccttaaccattgttcaattcgctgccgtgcgtgaccttcaacgggaaaaataaaaggcatttgctgccaatcaataggtttttcttgcaataattgtgtcgccaaacaagccactcgcggggcaattagggacaaactaatatcatctattttatgaaacactacactagagggcagattatttggtttccccgcaagcgcgagatcgacttgttgcgcttgaattaattctagtgctaacgctggatcgcctgtagtcagttgaatttccactttaggataacgctggcgaaattctttaagtacgtgaggaagatggctataggatgcggttacagaacaaaaaagtttaatttcaccgcaaagttcatcggattcatctttcagttgttgtttaaattgttgccagttttgccattctgttttagcaaattgcaaaaatttctcgccatattcagtaagtttgacttggcgattatcacggataaaaagtgtcttccctaactcgtcttccaatcgttgaatttgacgggaaagggtggatggggacatgtggttttgggtggcagttttggtgaagttttttgtatcactgaggtggatgaatatttgtaggtcggtaaattccataatttcttcttttatttaatatcgggtttcgccgatggcgacctactttttctttgctcgtgcaaagcaaaagtaggcaaaaagaaaacacgccctactttgccttatttcctgaaaaattggaaatttgcttaacggaaattttctgaactcgctacgctcaaacagacgaaaatttcctacaaatttccaatttttcaggcggcaaagaagggagctaatttattctttcttcaatttaaagtgcgggtaaaatttagcgtattttgaaaaataccagaaaactaaccgcactttttaataacgctctgatatattctgagccccatataaatcgcctttgcgactttcaatttttaggcaatttgcgtctgtttgagcgtagcgagttcagcaaattgccgttaagaaaattgaaacaaagcaaagaacagcgatttaactggggcgtgttttctttgcctactttcttttacacgagtaaaagaaagtaggtcgttcatcgagcgaaatacgatgccaattcacaaaaaaaaataattgcacaaatcgcaacattacattcccataatatcactttacgcaacaacaaaaaatcctataatcaaaccacaacaaaaaaatatgcaaacacaacatcatacaattatcaaccttacacaattaaggacaaaaaatggctaactatttcaacacattaaatttacgtcaaaaattagaccaattaggtcgttgtcgttttatggatcgcgaagaatttgcagatgaagcaaacttcttaaaaggcaaaaaaatcgttatcgtaggctgtggtgcgcaaggtttaaaccaaggtttgaatatgcgtgattctggcttagatattagctatgccttacgccctgaagcgattgcagaaaaacgtgcgtcattccaacgtgcaaccgaaaatggttttaaagtgggtacttatgaagaattaattccaactgcagatttagtcgtaaacttaacaccagacaaacaacactctaaagtagttgccgatgtcatgcctttaatgaaaaaagactctgcatttggttattcacacggtttcaatattgttgaagttggcgaagaaatccgtaaagatattacggttgtgatggttgcgccaaaatgtccaggtactgaagttcgtgaagaatacaaacgtggtttcggtgtgccaacattaatcgcggttcatcctgaaaatgacccgaaaggcgaaggcatggcgatcgcaaaagcatgggctgctgcaactggcggtcataaagcgggtgttttagaatcttcattcgtggcagaagtaaaatctgacttaatgggtgagcaaactatcctttgcggtatgttacaagcaggttctatcgtatgttatgacaaattagtggcagatggtaaagatccagcatacgcaggtaaattaatccaatacggttgggaaaccattaccgaggcattaaaacaaggcggcatcacattaatgatggatcgcctatcaaacagtgcaaaattacgtgcatttgaactagctgaacaaatcaaagaaagccttggtttcttatattacaaacatatggatgacatcattagcggtcacttctctgcaacaatgatggcagactgggcaaatggcgacaaagatttattcgcatggcgtgaagcnacaggtaaaacagcctttgaaaatgcgccaaaatatgatggcaaaattagcgaacaagaatattttgataacggcgtattaatgatcgcaatggttaaagctggtgtagaattagcctttgatgcgatggttgcaagcggtatttatgaagaatcagcttactacgaatcacttcacgaattgccattaattgcgaacactatcgcacgtaaacgcttatacgaaatgaacgtggtaatttctgataccgcagaatatggtaactacttattctctaacgtagcgaccccaattcttgcaaaagaaattatccctaaccttcaaaaaggcgatttgggcgagccaactccagcagtggaagtcgataacattaccttacgtgatgtaaacgatgcaattcgcaaccaccctgttgaattaatcggtcaagaattacgtggttatatgacagatatgaaacgtatcgcagtcgcaggttaatgttaaattgaactgaattaaaaaccgactttgtcaatataaagtcggttttttcatagataaaattaatcataaaaatgcacgttaattaccacatgcatttttcttatttaagcatccatcgacatacaaagtaaagttaatggatgaatacaagtcacgttagatgacatatcaatttgccatttacaggtttgacattcagatataacgtaatcaaatccaccctcgttaatattatcgaatagatttttaccaatagattgtgaaatttcatagttttctgatttaaaaccgtaagtcccagcaataccacagcattggctaggtaacataatgatttctaaactcggaatttttttcaacacttccaaagtataaggtgcccaacccgccttatctacgtgacaagcggtgtgataagccactctaagtttaagtggtttcaacggtaatgttttaccttctttgaaaagctgatataaaaatggggttaccatatggatatgcggacggactttggcgttatcgatacctaaaatatgatggtattcgtcacgcagattaagtgaacaacttgatgcctcactaatcacatctattccattttcatctaccatttttccaatgtaatcggtattgaattgtgcaatattacgagcgcgattaggaaaaccgtttaccattaatggtaagccacagcatttttctttttctaataacattaccccaatattcatcgcattgaacactttaaggaattctttgccaagctgtggattattataattaacataacaaccgtggaaatatgctacttttcgctcaaatttttgttggtcttgtagcgcatttttcatataccagctacggaacgtaccaaacgcatatttaggtaaagtacgtttcttactgatattaagggttttttccaacataaatttggtggctttcagacccgtaatggtgttcacaatgggggcaagtggagtattgattttccccattacatctgtgttacttaaaatcgcatcacgcaatttattcattaacggttttttagactgcgctaagtgattattacgcgcacgtacaattaaatcgccaattttcacatcagacggacaagccacttcacaacgtttacagttggtgcaatatttaagtgcttcatcataaagttcagcagattttaagcgtaaacgctcaccatctgggccagattgttttggccctggataaagcggattattacgtgaaacaggacaaacagcagtacaagcagtacatttaatacagctttcaaaactttcatcaatatatttatagctttcaggcgaattaagggattgttttgcactatcaatgagtcgttgaatattattatccatattattcccccttatttcgctaagatttcatctgccactgccaaggcagttacaacagccacacccgaaccacaaccaagttcaagggcattaaaaccaccaatcacattaccgacggcatataaattcgttaaaaattgaccgcactttttcacttggcactgggcattaatcgctacgcctgctgattgataaggttgtggatgagcaaagcgatgagcagtccaagtgaaacgatctttattgttaaacccttcaacaccgataatatcggattcaaaaactggctcataaattttatcaaattcggaaataagccctttgctgaagaaacttcctgacgccaatacaaaattatcggcagtaatttcttcatcttcgagcaaacgagtattgatacaacgtacttgatttccttcaaatgttgcattcaatgcactgtcgccattaatcattaaaccaccaagggattcaaatttatggcgtaattggattcgttggcgcataccaagtaatgatggtggcagtgttggtaattcaaataatgcaagtttagttgcatcacgaagtgcggtcataaattcttggttttctaaaccaaagcaagcaggtaaaaagaccgcttctgcaccttgcgctgattctataatttctttaactaaatctttaaaagcgagtttgtgttctaaaagttgagagatattgacactacggaactcacgagcatttttgcgaagttcatctaattgtggaatatttaagaaaccactcgttacttcacaatgttcaaattgtgggtttaacactaaatttgccgctaaaagttgaggttgaaaatcgtgataaccttcaataccaagcactgcaatacgtttatgcggaaaaggttcattaccttgcacagttggcacgctatttggcgaaagccacgcaccgcgtaaactgcctaagcctgttacacgccagtgatttttttccgtagaaccaattaaatcaagatgtaattcattggctaaacgttcaaaatcttgtgctttagcaagcactttctctgcacccaataaactataagggtgggcaggtaattcattgcgaagtgcggtaatattttcttttaaattttctactgcgcgattttccccatatgtcgttgatggcatacggcttaataaatctaaagagccagatgcaaaatcaatggctgcttgaccgttgttgataatcacgcaacgtttaccgcgttgttgaagggcgatggcacaggttaaacccgccaaaccaccgccaataatggctacatcaaaattcattgctatccgtcccttgttgtgcttgttcatcaagcggtttcacatcatttaaacctaatacactagcatacatccaagaggtaaattcggcttcgcgaatagcttccccccaagcaatcggttcaataccacgccagcgttcttccataaaggcggaaagttgagtggttgattgacgtggtgttgccacttcaaaacgattcattagtcctgcagcacgacaagcacagagttcagcttgacaagttcccattccaactcgggaacgacgacgtaaatcgacgagattatttacatccagttcatcaacagcgtaacgaacttcccccgctgttaccgcttcacattcgcaaaccattgaacgatctaaacgttctttttcaagcaaacgagtagcccgtgaaccgtgacgatatacggcagaataacgaatagtacttggtaatgaaatgactttttgattggtctcttgacgactttcagtagagcctggcaaaggttgctctgcagtcacacaacgtgccgttttattgagttttttacaaacaaggtcagtcgcccattcagccattaaacgataagtcattaacttaccgccagtgatagtaataaagccatctaagccatcacgttctgcgtggtcaagtagcacgataccacgactcacatttcgacctgatggatcatcatcgcttgcaactaatggacgcaccccagcataagcacgtaatacgcgagtatgacgcaagctaggtgcgagtttttcaccttcacggaaaagaatatccacttcctctggtgttacttccatattatcaatttgatcataaggaatgcggctagatgttgttccgatcacacaaattgtatcgccagggacgagaatatccgcatcagcaggtttacggcagcggttaattacaagtttattaatgcgatgacccattacgagtaatgcgccttttgcagggaacattttaattttgagatcggcatattccgcaatcccttgtccccaaataccaccagcatttacaacaagcggtgcaaaaaattggcgttctctgcgatttttgtgatcgtacgcattcacgccaatcacttttccaccttcacgaatcaaattttttacttcgcaataagtgaacatttttgcgccgttttctgtggcgtccatcatattagaggcggttaaacggaatgggtcaatagaaccatctggcacaacaacagcacccactaaatctgggtttacagaaggctccataattttagctagttcaggatcaatggcttgtgcatcaattccagattttgcacagctctcaaggaaggttttttgatagtcgagcgaatcttcaggcaaagtgataaataagccttccgtttcatctacgcaatgacgcgcaattttgcgcaaaatgcggttttctttaatacattcttcagcagattcttggtcgttcacggcgtaacgtgcaccactgtgtaataatccgtggttacgtcctgtggctcctgtcgcaatatctcgacgttccaataaaatacaatcaatgccacgargtgcgcaatcgcgcgcaatacctgctcctgttgcgccaccaccgataatgatcacatcagtgctaagtgacgaaagatctccaacatctttatagatactaggcgataatcccattgtttacccccgattcccaaaatgtaagaaaaaataatataaaaagtgtaatcattgtagggaagtgcggccaaaattaacaacattttgagtgtaaaangaaagcgattttgtgatattgatcacaataattttcgcattcgctcaaacggtgtaaagatttgtgaaacacttcacatttttgattttttttactttcttattttttattttcttttatgattcgcaaatcccttactgtttcaaaagggtaaatttagatgacacataattaaaaagttggagaaaaaattatgtttggaccattcaaacccgctccgcatattgcggaacttccagcggagaaaattgattccacgtataaacgcttacgttggcaagtgtttgcagggatcttcttcggttatgctgcatattattttggtgcgtgcaaactttgacttagcacaaccaggtttaattcaagctggcttgtactcaaaagcggaactaggtgttatcggctcagcggctggtcttgcttacggtttatcaaaattcgttatggcaggtatgtctgaccgttctaaccctcgtgtattcttaccatttggtttattgctctctggtttatgtatgaccttaatgggtttattcccatgggcaacttcaggcattgccattatgtgggtaatgatcttcttaaatggttggttccaaggtatgggttggcctccatgtggtcgtactatggtgcattggtggtctaaatctgaacgcggtactatcgtgtcaatttggaatacggcgcataatatcggtggtatggttccaggtgcaatggtgttattagctagtgcaattttcttcagcactcacggtattgaagcgcaggcgaaagatgtttggcaacaatcattatacttccctggtattgctgcgatgatctttgcaattcctgtgtacttcgtgatgcgtgatactccacaatcttgtggtttaccatcaatcgaaaaatggcgtaatgactacccagatgactataacgaaaaaacttacgaaaacgatttaactgcaaaagaaatcttcgtaacttatgtattaaaaaacaaattgttatggtatatcgcgattgctaacgtgttcgtctatttaatccgctacggtgtattaaaatggtctccagtttacttgagtgaagtgaaacacttcaatatcaaaggtactgcatgggcatacacaatctatgaattagcagcggttccaggtacattattatgtggttgggtatcagataaagtgtttaaaggtaaacgtggtttaactggtttcatctttatgatcttaaccactgcagcggttgttgcgtactggatgaacccagctacaccagaagcagagcttgcaaactactcagcttggtatgaaaacccatatcaattaactgatttcgtattaatgaccttaatcggtttcttaatctacggtcctgtaatgttaattggcttacacgctcttgagcttgcaccgaaaaaagcagcaggtacggcagcaggtttcactggtttattcggttacttaggtggtactgtatcagcttcagcagttattggttgggctgctcaacattacggatgggacggtggtttctacgtaatgatcggcggtggcgtattagcagtgttattactcttaatcgtaatggttgaagaaggaaaacacaaagcgaaattaggcgatacttacggtactaaataattagcttaaaaaaggcggtgggcaaattgcttagtcgccttttttgtaactatcataagaataataaaaagataagtatcatttttgggaaaagtaaaaatgaataatgaaaatatggtaagagttttctatgtcttattaatggggttaggatttcctattatgagatttatgagtattcattttgaaactttaaataataattctgttagatttttatctggaggatcattatttgttattatttgcttaattaaatttagaagtgagttaaagaaaataattggtgaaccnaaaattattctttatttatttatttatttatttattttaggtatttttatgactggaaatatgtttttctttattaatggtttgaaatatacctcagcattggcaggaagtatctttggaatacttgctatgcctttagcaataattatagctggaatattctttaaagatgaaagagatcgtataagacaaaaagaattttatattggagaattattagcaattattggttcgctaatattcgtaataaatagttcaaataatgatggaaatacagacttttttcttggggcaatatttctttttacagctatttttattcaatctgtacagaatttaattgtaaaaaaagtagccaaaaagataaatgctgttgtaataagtgcatcgacagcaacaatttcaggagtattatttttatgtttagcttttaatactaaacaaatatatttattacaagatgttggcattggaatgttgataggtttagtttgcgctggcttttatgggatgctaacagggatgttgatggctttttatattgttcaaaaacagggaatcactgtttttaacattttgcaattattaattcctctttcaactgcgataataggttacttaacattagatgaaagaataaatatctatcagggaattagcggtattattgtaattattggttgtgtattggcattaaaaagaaaaaacaaggagtgttgatatataaagtagatgatgttggtggaataggtatagttaaatatctggttcaattggttttattaagggcgttagcaattctccatttaagtttatgtttgaattagatattttgggaaaagatggaagaataaagctgttaaataatgctgaaacatatgaactataccaatactcaaataaaaataattctgctggaaatgattataaatctctaattctaacttgtagagaggataatgactatcaatcagaaagaatgattaaagccattaaaaatattattcattgtatgactaataatcatcaacctatttcaagtgctgaaacatctttagaaactattaaaattattcacggaataattaattctgttaaaataggtaatgatcctaacaatatataaggagaataagtatgaaacttaaaactttagccctttctttattagcagctggcgtactagcaggttgtagcagccattcatcaaatatggcgaatacccaaatgaaatcagacaaaatcattattgctcaccgtggtgctagcggttatttaccagagcatacgttagaatctaaagcacttgcgtttgcacaacactcagattatttagagcaagatttagcaatgactaaggatggtcgtttagtggttattcacgatcactttttagatggcttgactgatgttgcgaaaaaattcccatatcgtcaccgtaaagatggtcgttactatgtcatcgactttaccttaaaagaaattcaaagtttagaaatgacagaaaactttgaaaccaaagatggcaaacaagcacaagtttatcctaatcgtttcccactttggaaatcacattttagaattcatacctttgaagatgaaattgaatttatccaaggcttagaaaaatccactggcaaaaaagtagggatttatccagaaatcaaagcaccttggttccaccatcaaaatggtaaagatattgctacagaaacgctcaaagtgttaaaaaaatatggctatgataagaaaaccgatatggtttacttgcaaactttcgattttaatgaattaaaacgtatcaaaacggaattacttccacaaatgggtatggatttgaaattagttcaattaattgcttatacagattggaaagaaacacaagaaaaagacccaaagggttattgggtaaactataattacgattggatgtttaaacctggtgcaatggcagaagtggttaaatatgccgatggtgttggtccaggttggtatatgttagttaataaagaagaatccaaacctgataatattgtgtacactccgttggtaaaagaacttgcacaatataatgtggaagtgcatccttacaccgtgcgtaaagatgcactgcccgagtttttcacagacgtaaatcaaatgtatgatgccttattgaataaatcaggggcaacaggtgtatttactgatttcccagatactggcgtggaattcttaaaaggaataaaataatatccctcacnnccgtgggtaaacatacccacggttaactaggtttctatatcgtagaaactaaaaatctactctaacagagtaacatcataatcaatctaggtgttctaacctagaattcaaataaggaggctatttcaaaacactccgtattcttttttaataaattctcttccctttacttagggaaaacactcttcatttcaaccgcacttctaaggagtgatctatggataaatcattaaaagcgaactgtattggcgagtttttaggtacagccttattgattttctttggtgtgggctgcgttgcagcactaaaagtagcaggcgctagttttggcttgtgggaaatcagcattatgtgggggatgggcgttgcacttgcagtatatgcaacagcgggtttatctggtgcacatctaaaccctgcagtaaccattgccctttggaaatttgcttgctttgatggcaaaaaagtaattccttacatcatttcacaaatgctcggcgcattctttgctgccgcattagtttatgccttataccgcaatgtttttatcgattatgaaacagtccacaatattgttcgtggtacacaagaaagtttaagccttgcgggtacattctccacttatcctcatccaagtttaagcattggtggcgcctttgctgtggaattcgtgattactgcaattcttatggcattaattatggcattaactgacgatggaaacggagtacctcgtggtccgcttgccccattattaatcggtatcttgatagccgttattggtggtgctatgggaccattaactggttttgccatgaatccagcacgtgacttcggaccaaaattctttgcttatctcgctggctggggcgaactcgctttaactggcggacgcgaaatcccttattttatcgttccaatggttgcacctgttttaggtgcattagctggtgcatggttatacaaaaaagcaattggcggcaatttaccttgtaattgcggctgcgaataattatttgaaggagtaatactatgacagacaaaaaatacatcattgcattagaccaaggcacaacaagctctcgcgcagtattattagatcataatgcgaatgtggttgaaattgcacaacgtgaatttacccaaatctaccctcgagctggttgggtagaacataacccaatggaaatttgggcaactcaaagctcaaccttaaacgaagtcgttgcaaaagcgggcattacatctgatgaaatcgctgctatcggtatcaccaaccaacgtgaaaccaccattgtatgggaaaaatcaaccggtacacctgtttacaacgcgatcgtttggcaatgccgccgtactgcagacattaccgataaattaaaagccgatggccatgaagaatatattcgtaataccacaggcttagtggttgacccttacttctctggtacaaaagtaaaatggattttggataacgttgaaggagcacgagaaaaagctgaacgaggcgaattattatttggtaccgttgatacttggcttgtatggaaattgactcaaggccgagtgcacgtaaccgattataccaacgcatctcgtaccatgttatttaacatccatactaaacaatgggatgacaagatgcttgaaatcttgaatattcctcgttcaatgttacctgaagtacgtaattcttctgaaatttacggccaaaccaatatcggtggtaaaggtggtgtgcgtattcctgttgcagggattgctggtgaccaacaagccgctctttacggacatctttgcgtacatgcaggccaagccaaaaacacttacggcacaggttgttttatgttactccacacgggtaacaaagctattacatccaaaaatggactactcacaaccattgcttgtaatgcaaaaggcgaaccagaatatgccttagaaggttctgtatttatcgcgggtgcatcaatccaatggctccgtgatgaactcaaaattgttcacgatagttttgactctgaatactttgcacaaaaagtgactgatagtaatggcgtatatgttgttccagctttcacaggcttaggtgcaccatattgggatccatatgcacgcggtgcgatttttggtctttctcgcggcgcaaaccgtaatcatattgttcgagcaaccttagaatctattgcttaccaaacccgtgatgtcttagaggctatgcaatcagattcgggtgaacgattacaatatctccgtgtagatggtggcgcgacaaacaataacttcttaatgcaattccaagctgacattttagatgtaaatgtagagcgtccagttgtgaaagaagtaacagcgctaggcgcagcttatcttgctggtttagcaacgggcttctggaaagatttagacgagcttcgcgataaagctcgtgtagaacgcaccttcagtccagacagcgacaatgaaaaacgtgaacgtcgctacaaaggctggaaaaaagcagttaaacgctcattagaatgggcaaaagaagatgaagaataatttataaattaattctcatacaaaaagtgcggttaaaaattcttttattttaaccgcacttttttgtataaaawttattttctagagagaggtggaacaaaggttaaacctaaatcccaaggttgctcaatccaagtattttgtggaatatcaattacgtaatcatccactaattccgcacctgcaggttttgcaaatacagtgacaaattttgcattagggtacatttgacgaatggcacgcgctgtattacccgtatcaactaaatcatctaccacgataaatccttcgccgccatttggcacttgggctgcatgaagaacttgtagttctccctgattattgtgatcgtgataacttgcgatacaaacggtttcaatatgacgaagacccaattcacgagccaatacagccgctggaaacaaaccaccgcgactcaccgcaataatacctttccattgggaagctggaagtaaacgttctgataatctgcgggcatgcatttgaaacatatcccaagttaccacatatttttcgctcataattgcaccttagtttaaattttgcgtaaagatgcactacccgcatttttcacagacgtaaatcaaatgtatgatgccttattgaataaatcaggggcaacaggtgtatttactgatttcccagatacttgcgtggaattcttaaaaggaataaaataatttctattataaccgtaggtagtttatttacggttattaatgccatctatgatgaaaaacacttttcaattgaaaagtgtttttcagaaagacttactataccctgaatgaataggaacataatatgaaaacaacgttaaaaatgaccgcacttgcggctctttctgcttttgttttagctggctgtggttcacaccaaatgaaatcagaaggacatgcaaatatgcaattacaacaacaagcggtgcttggattaaactggatgcaagattctggcgaatataaagcattagcttatcaagcgtacaatgcggcaaaagttgcatttgatcacgcaaaagtggcaaaaggtaagaaaaaagcggttgtggctgatttagatgaaactatgttagacaacagcccttatgctggctggcaagttcaaaataacaaaccattcgatggtaaagattggactcgttgggtagacgcacgtcaatctcgtgccgttccgggtgcggtagaatttaataattatgtaaacagccacaacggtaaagtgttctacgtaacaaaccgcaaagacagcactgaaaaatcaggcactatcgatgatatgaaacgcttaggtttcaatggcgtggaagaatctgcattttatttgaaaaaagacaaatcagctaaagcggctcgttttgcagaaattgaaaaacaaggctatgaaatcgtactttatgtaggtgataacttagatgacttcggtaataccgtatatggcaaattaaacgctgaccgccgtgcattcgttgatcaaaaccaaggcaaatttggtaaaactttcatcatgttacctaacgcaaactacggtggctgggaaggcggtttagctgaagggtatttcaaaaaagatacacaaggccaaatcaaagctcgtttagatgcagtacaagcttgggatggtaaataattttccattaaaaagatcgatttaaatatcgattttgaaaatttaattgaggggctaagctcagtttttactggcttagcctttttaatttttcaagttcactcaagtaatcatcattactacagcctgaagttttgctatgatgttgcaagcctttcaaaatagaaatcataagttaatgaagaaaaatttttcagcagggaaattgccgtctaaaggaaaaagtgcggttaattttcaccgcacttttaagccaaaattaaaacccaaaacgttgtcgttggatgaaaccaaagttgtgttattcaataaaccttttgatgtactcacgcaatttaccgacgaacaaggacgcgctaccttaaaagattttatttcaattccaaatgtttatgcggcaggtcgattagatagagacagtgaaggattactgattttaaccaataatggcgaattacaacatcgtttggcagatcccaaatttaaaacagaaaaaacctattgggtgcaagtggaaggtatccctgaagaaaccgatttagcacaactgagaaaaggcgttgaactcaaagatggcgtgacaaaatccgctaaagtgcggttaatttcagagccaaatttatgggaacgcaatccacctatccgagaacggaaaaatattcccacaagctggttagaaattaagattagtgaagggcgcaaccgccaagtgcggagaatgactgcgcatattggtttccccactttacgattagtgagagtgagtatgggcttattatctattaatggattagaaaatggctcatttagattattatcattggatgaaataaaagcgttatttcagaccgtcaaattataaaaatagggcaagtatttagcttgccctaaatttttctcccataaatattgcgcactgagtaaattagcactatccgcaacgcgatgagcttgagcttggtcaatattgaattgctcacttaaccctcaagcggtgctcgctcgaatatctgcaacttggaaatttttttctaggctataaatgacgccttcgcgcaatgcaccgtcagaatagcgcatttgttgaatatgaaaaacgtcaaacactgcacttaaaatcgctaaaccgggtacaaaaacatccacgcggtcttggtttaaaccgttaatatttagctcggtaaaatgcttggcttgtagtgtttgttcaattagagcatttaatcgctcggctgtaatggttccatttggatcgagattagtcgcaatgacttgcgcaacagttttaatcgtccccgatgagccgagcacagattgccaacctaatttgcgatattcaaggcctaaatcttcgattttattgaccgcactttggcgcgcgcgttgaaagttttctggggaaatgatgccatcggtaaaaaattgagtcgcaaaactcacgcatcccatatgtcggctttcagccataagcggcgtgaaatcatcgccgataatcatttctgtcgagccaccaccaatatctataacaagctttctgcctttttctggctgagtatggcatacaccagcgtagatggttttagcttccgtttgcccactaataatattaatgggataggggaaaactttggctgcttgacgtaaaaattcgtcattattcaccgctcttcgtaacgtataagtgccaactacattgacgttttccataggaaaaccttgtaaacgttcagcaaataaggctaagcaattcacgccacgtgtgatggcctcttgattaagcaccgcattttcatctaagccttctgcgagtttaactttttgttttaagcgcgaaagcacttggattgagccgtttacaatacgcgcaacaatcatatgaaagctgtttgagccaagatcaattgcggcaatttcacgtacattgccacgatgtttgggttctaaaatagagtcgttcataacattcctaaaattcaaatttataaagcaaatcaaacacttggtttgtgctagaaacggattgaaaataaagctgtggcattaggcgataacgtaatgtaacttctgctaagccatcaaataaacctacgccatattttatttgtaagcgattggtaatattaccacttaccgtcactttggatttatcgcccacgccagatgtaccaaggtttaagtcttgaataccaaaaacttcgccaatactgcccactaatttaccgctctttgaaatgcctaaaccaattaatgctgcaccaactgatcccgttgaacccacttctccgctgctttctaacgaacgacctgttaataaataagaaagtgcttgatcttgtggtttgcttggttcactgaaaatagtgacttctgggctatcagctatgccaatcactctcacgccagcagtaattttgctgtcttccattgtttcaggattacgaatagcctcaatattcaatgtaggttgtgtcgcttgcccagaaaagctaataagccctttacgaatcagtaaatcttgcccgaaagaagcatagcgacctttggttaaattaatctgaccaaataaacctaaattgcctttatcttgtttcacagaaagtaaaccatcaagattggtttttaagccataggcatcaaggctaacgtctttaccaatattgatgcgtaaatcagagcgaatttccattcctgattttgtttttgcggcaaattcacgtttaatcagttcttctttgctcttgtgcgggccatttaaaataacttcatcttcactcactggctcagcagtatctggcagactgtcaattttaatacgcgcccaaggaatatccactgttccgcttaaattcaattccttcggattggcttttatcgtgatatttggactgaaacgtagcttcgccatagaaggaatatccacgttgaaattatttgcttgcgcatttaattctgttgtccaatgttcaatattcgcccagtttgcacgtccagttaagtttaagtgactatctactgttttgattttcccttgcaatgttgaacggttatcattaaagcgtagagcaatatcgccatcagtaatattgactggcatagattttaatttggtacgaatattacgaatattgaagtcaccatttaataatggtttctctaaatttccaccgaaactcaacttcgatactacctcaccattcactgattcaccgctagtaagtagctgatttgcgatcgacaagtttaatcgttctatcgcaagggttccgccaagttggcgatttttcgcaagatcgtttaaatgaatatcgcctacaattctgccttggttatgcacattgatgtctgtttttaaaaccaaattattattttgaatgtcggcgttaagggttaattttggaatatacaatttaaatgtacggtaatccaatttttgagagaaggctaaatgattgccatctacgttggcggtaaattggaatggtttatccgtaaaccaagccacatttccttgcacttgtaaattgcctttgaggctgttttgttcgataagtttattcactaaatccaaattaacacgtttaaattggaaaggaatattgccttgcttgcctgcattgaatgcttgtgggaaacataattctacatcggtgttttgccagcaatgtgaggcaatattggcttgtgtttgtttgttatcgtaggacaccgcaatcgcttggttggattttacatcgccaatcggagtttcaaattttacctgtgaaattgtgcctttccactgctccaaagtgcggtcaaaatgtccgttaatttgtaaatttgcagcaacaggctcgccttgagattttaggattagtttgtgattttgttcatcgcctgataaatcaagatcaagtaaatggagtttaatatttccgccataatgaagttgttctgctttaatattcaattttccactcgagagtgaggcattgtttatatgaccttttatacttgctttggctaactgaaaaccctgtaaatgtaaattagatgaagttaaatcaagatcaagattaggtgtcgtaatttgaccagaaatcgctactcgaccttttactcgcccttttaaatctgaccataatccacgtaaatttggcgcatttatatctagcgcaaaatcagaatgatcatctaatacgccactggctttaagataattttcgccatatttaatctgtaaatcaggcactgttagaagtacattttgattgagcgttgcagaaccttttaaactgataggttttgcagaaagcattccgtttaaatcggctactggcacttctacttgccatccttgagagcctgcaaaaccacgtgaatgcaatttaccagatagtgttgcaggcattacaggaacaaaaaaagcaatattcattttttctaaatcggcttgaatatcccagtttgcaccatttttccaattcgcattacccacaaattcacttttaccgtctaatgaatctatccccaatttattgacggtgacttcataaagtttgccgtcggcattaagttccacttgagatgcgggaatataattcattcctgctacatcgcccttaagttcagcgtgataatttagtaaatcccctgtgagtttaagcgtcacatcattaattttgagtggcgtcattgtgtttacaaaagtgtattgtccttttgccacatttaatgtgaggtttaagggcattttgtcttgtgctaattgcacgttgccattcagttcagcatctaacacgccttttgttttcaaagaaagtgcggtggattttttcaatgatcccgaaagcgtaagatccacatcactcgcgggcagaatttcttttccatcggatttcaatggctccaaatgggattttaaagttaaatcgagaggcatatcgccatcgagttgtaatttaccttgtgaagaaagattacccaacgagctttctaccgctaatttttgtaattgcagttggttatcgacggtatccgcctgtgcaattaaactagacatttcaacagattgaagcgtttcgcctttttcattcactgcttgatactgccagtttttgcctgaaatttcaggaatatgtaaatcaaaaggaagaatgatttctgatacattgcctaaaaaagcaggcgttaaagattgctcaatcgcagcccaatctacaggcttattcggctgttcggctttcggctctgatttaacttcagacaatttttttgcaatcactgaaatatcgttaatttcagtcggcgcaatagttaagcctttttcattatttaaacttaccgcacttttaaaatttccaagcgtaatactagtctgatcaatgtttacagataaatcttgcatcaccaaattttctgcattgatactaattggcaaggaaatacgcttcattgagccagactttgaattatcaggtgccgatggaggcaataatgcagtattaatcgcaatcgtcggtttatttaaggtgaagtctcgtaaacaaacttcacgtgaaaacaaacaaccaaaatcgagctgaaacgtgcttgtgcaatatgtgtctcaatcccagcggtttgataacgaacattctttaacaccaagccattttgtaatccgccttcaacttgctcaacggaaaaactatcaagcattttatcgacaagttgaattaaacttttttgccctgcatcgaaagaaagtgccccagcaacacctaaaacaggcaccaaaatgaccgcacttccgatacaaacagccttgcgtacccaatgttttttattaggtttctcaggtgattttggtgaagtttctgatggttgtatttgttctgtcataaattcaccttaaatttctgtaccaagtccgatgtaaaattgaatatttttgctgttatctttatcacgaatgggtgtggcaatatcaaatttaatcgcaccaactggcgatgcccaacgcacaccaacgcctgtgccataacgcagctcttttgctgtgtaattatcggcagctaatccactatctgcaaaagttgccgcccaccaatttggatagacttgatattgatattctaaagaagtggtaagcaatcgcgaaccacccaccaattttccatttctatttttaggcgcaatttttttatagccgtaaccgcgcacactacgatcgccaccagcaaagaaacgcagtgtaggcggaattttttcaataccttttgtatgtaaatacccgatttcagcacgagcaacgacacgatgattttctgcataagtacgaacccacgcgctagatgcttgcacttttataaaagaagattctgatagccaaattcgtttgcttaaatcaaaagtaattttttgcacatcgccccaagtggcaaaggaaccaccacgtaatcgagtacgagtaaatccaacagttggataaagaagtaaggttttatcagtgatatccgcttgtgtaaaactgtcgtatcgcatacgaagtccgccaaaatattgccaaccatgcgcattattccaataacgtaacgctgacaacgtaagcactctcgtattggtatcattctctttttccccttcccaaccgacgggcaaaatcatagtaataatttaatggatttttaagcagtggcattcgataagttgcctctagagtttgttttggtgcagagagataaagatttgaacgcaaactatgtccacggctattaatccaaggttttgtccagcctatttgtccgtgaacgccgccatcagtagaaaagcccacaccgagttccatcgcattttttttacgtggataaagaataatctccacatccacagttttgcttttatgattaacattaggctgaactaatactgagctaaaccaatttgaagatggaaaatcgctggttaaatccgacaaattattcattaaatacggatcaccagatttgatgttaagaatattatttaagtaatcatcccgaatttgtgaatggctaaaagtaatattgccataatgataacggacaccactatcaaataacattcgccaccatgcttgatgggtttcagggctgatttctaaacgtgaaattttaaagttcccatcaaaatacccacgatttaatgctaaacgtgaaatcgctgttttgtaatcatcgtaagtttggtgctcaaccaaaacgccatctttcggtaagtttttacgcaatgcattaaaattttcatcttgtgcggcttccccctcaatttggcacatcagtccccgcaatttttgttggctcgcctggtgtaacatgagcaatcaataaatcgcgtttgccttgacgctgttttcgttcaaaacgcacggaagattcataataaccaaacacacgcaaaccacgatccacggctttggttaccaaatgttgatagcgttcggagccatccatttcttctttattaatcaaattaacattgagatctgtattacgcacagcacggaaaccacgaatgccttgaacttcaatatcaacggtttgttcagcaaatgcgggaaagcaacttaatgctaaaaaaagtgcggtgagttttagcgattttttcttcattttaaggggttaaaattttctaagtaaattgcactatagtctaccgagaagttcgttaggatccaatattttcagtgcattttgtcggttttttcataaaaaataccgcacttcattgccaaagtgcggtaaatttttgagctgttttaattagtgaccgccgcaaccacagctgccgtgattatgttcgtgattatgttcgtgatgatgaccaccacagccacaaccgtgaccttcttcgtcatcatcgtggctgtgcgcaccgtgaacgtggccgtgagcaatttcttctaacgttgcttcacgcgctgcaacaacctcaacggtgaagtgtaattcttgccccgctaacatatggtttccatcaactacaacttcatcgccatcgatttcagtaatcaccactggaactgggccaatgtcagtatccgctaagaaacgcataccgacttcaagttcatcaacaccttggaatacatcttttggtacacgttgaaccatattttcgctgtatgcgccgtaaccttcttcaggttgtacacgtacttcaaatttgtcgccaacttctttaccttcaagtgctttttcaagaccaatcactaaattattgtgaccttgtaaatattcgagtggttgatttgctggagcttcatctaccaatacgccatcttgtgtgcgaacttggtaagaaatgctcaccactacatttttttctactttcattatgttttccttataaaaaatccgttaaaaaagtcgtaccattgtagcgaaaattattccgcgcgcaagactttacggattaatgaacacgaggctcttcttcatcttcatcatcaaaaaattccccatcgtcaccgtattcatcttcatcatcaagaaattccccatcgtcaccgtattcatcgtcatcggcatttgggtcttcaaaataagttccccaaccgtcgtaaataccattatgtttttctaataacggaaggatttctttttgttgagcatcaataatttcagcttttaattctacttcactgatgatgtcaaaacagaaaattggtttaccgtcatcatctttaaattcttccgcttcggaaacttcatagcccgctttaaacgcatcaaccgcaattttttctaacaaatcaaaatcgtggtgtgcaatgtgatgctcaataatgtaaagcgcatttggttcactgccatcattaagtaaatcttcgataatttcacgggtttctgcttgtaattcagctaattttgacataataaaatccttcaacaagaacaaaagtgcggttattttagtggataaatcacgaaaagtcgcatagaatttcgcacaattattttcgataaaaaagagcccttaactatgctcgaacaactcccttatttagcattaaaaactccgccaaaaaccaccgcacttttaaaggctgaatgtgcggattttattgtaaaagagcatttaggctatgaaatgtcaggtgacggtgagtttgttgcgttgtatgtacgcaaaacagattgcaacaccttatttgttggcgaaaaattagctaaatttgctggtgtttctgaacgcaatatgggatatgcagggttgaaagatcgtcgagcggtgacagaacaatggttttgcttgcaaatgccaggaatggaaacgcccgatttcagtcaatttgaattagatggcgtagagattttaacggttactcgacataaccgaaaaattcgcacgggtagccttgaaggaaattatttcgatattttattacgcggtgcagaagaatctgatgagcttaaagcgcggctggattttgtggcaaattttggtttccccaattattttacggaacaacgttttggtcgggatggccataacctcacgcaagccttgcgttgggctcaaggggaaatcaaggtaaaagatcgcaaaaaacgcagtttttatctttccgccgcgcgcagtgaaatttttaatttagttgtggctgcgcgtatcgaaaagagcacaataaatcaagttttaccaaatgatattgtgcaattagcaggttcgcacagttggttcaaagcggatgaaaaagaagacttaactgccttacaagtgcggttagaaaatcaagatattttgcttactgcccctttaattggcgaagatattttagcagcaagcgagattgaaaatgaaatcgtaaatcaacattcagctttcgatcctttaatgaaacaagaaagaatgaaggctgcacgtcgcccattattgatgaaagcaaaagggttttcttgggcatttgagccagaaggcttgcgtttaaaattttatttgccagcaggcagttatgccacggcattagttcgtgagttagtaaattacacagaagaataaggaaatataatgcgaattttagttagtaatgatgatggttttcacgcggaaggcattcaggttttagcaacagaattaagaaaaattgcagaagtcattattgttgcacccgatcgtaatcgaagtgcagcatcaagctcgctcacattggttgagccattgcgcccacgccatttagataatggcgattattgtgtaaatggcacacctgcagattgcgtacatttagcgttaaatggatttttatctggtcaagtggatttagtggtatcaggtattaatgcaggttgtaatatgggcgatgatacgatttattcaggcacattagctgcagcccttgaaggtcgtcatttaggtttgcctgctattgcggtttcgttagatggtcgtcagcattatgaaactgcagcacgagtggtatgtgatctcattccaaaattacagcatcaattattaaaccctcgtgaaattattaacatcaatgtaccagacttaccttttgaagaattaaaaggttacaaggtgtgtcgcttaggttatcgttcatcttccgttgaagtcattaaacaaagggatcctcgtgatgaaaccatttattggattggcccttcagcattacccgaagatgaaagcgaaggaacagatttttatgccgtgaagaatggttatgtgtctatcacaccaattcaagcggatcttaccgcatatcattcattgctttctttgcaaaattggttagatcaggaatttaccaaatagagaaaaatatgaaaattttcggcacgatgtacgataaaacgatggaatggtcaaaacatcgttttgctgttttttggctctcttttgtaagttttatcgaggcgatattttttcctattccgcccgatgtgatgctgatcccaatgtctatgtcaaagccaaaaagtgcggtgaaatttgcattttatacggcaattgcgtctgtaatcggcggaattatcggttatgctattggtttttatgcaacggactgggtggaaaacattgtgcaacaatggggatatgctgcgcattgggcaaaagccgtcagttggtttgagcaatggggcgtattagttgtgtttgtggcgggttttagcccaattccttacaaggtgtttacgctctgcgctggagtaatgcaaatggcatttttcccttttgttatcaccgcatttgtttcacgtttagcgcgtttcttgctagtagcaaaattagctgcatggggcggtgaaaaattcgcagcaaaattgcgaaaatctattgagattattggctggtcagtggttgtactggctgtaatcgcttattttatactgaaaaattaggatagaaaatgaacaaattaagtcttgttttagtagctggatttcttttggttggatgtgcatctgaatcagttaaagatccagacgcattaccaaatggcattatgcaaccagtagaaggcactggtgccgttgctggcggtagttttatgccagaaattcaaaaaaatacgataccaacacaaatgaaataataacggaacaataaggaataactatgaaaaaatcgtttctcttactccctttgagtcttgttgtattatcggcttgtacctctaattttcctgcacctatttctgatgcagatggaaatttttcccctagtgtaatacaatctgtaaatggcagtaatgtaggtggtgcttggcaacctgaaattcaaaaaaattcattacctacaacgggaaatatggtcacgccacaacaaaattttcaaccgattaatcaacaaccaacaatgccaacagcacctgcacaacctgcatttcaaccctctccgaaaaccgtagttagtgcaccgacagtacaaacaaaaacagttaccaaaacagtcgctgattgtgtagatggacagcatattaatatcccacgtaatccaaataccaatgcgccagattacagcaaaatctcaaaaggctcttacaaaggcaatacctataaagtaaacaaaggcgatacaatgttcttaatcgcttacttggcggggattgatgtaaaagaattggcggcgttgaataacctatccgaaccttataatttaagtttagggcaagttttaaagatttctaattgtgacataaaaacggttactacaacggtttctgtaaaacaacctgcagtcacagcatcaacagcaacgccagttaaaccagcagtcacttatactccgggcgcaaacggtactcaaataggatctgacggtactattattggcccaattaaatcagaggctggcacatcgcctagtgtacctgtggcaacttcatcaacacaggttacatcatctgtaaataatgcgaatagcacaccaattaattccaatgtcgttgcgccaatcgcctcaaatgttgtgtggcaatggccgacttcaggtaatatcatccaaggtttctcaagcacagatggcggtaacaaaggaattgatattagtggttcacgaggacaagctgtaaaagcggctgcagcagggcgaatagtgtatgcaggcaatgctttacgtggttacggtaatttaattatcatcaaacataatgatgattttttaagtgcctatgcgcataacgacaaaattcttgtcgccgatcaacaagaagtcaaagcaggtcaagacatcgcaaaaatgggtagctctggtacaaataccgtgaaactccactttgaaattcgctataaaggtaaatcagtggatccagtacgttacctaccaagacattaatcttcctgtaaaaagtgcggtaaaaaatctcaacaaatttttaccgcacttttatctggctttttcccctttcggcacctaaaatagccgccacaaaacctatctttattcagtttcaaagcaggtaattagatgatttccgaagaaaatttccaacaacatacgccaatgatgcagcaatatctaaaactcaaagcggagaatccagatattttgttgttttatcgcatgggggatttttacgagttgttttatgacgatgcgaaaaaagcggcggcattgttggatatttctttgacgaaacgaggtcaatctgcaggacagcccattccgatggcaggaatgccttatcatgcagtggaaggttatttagcaaaattagtgcagttaggcgaatctgtggcgatttgcgaacagattggcgatccaacgacgagtaaaggaccagtggaacgtcaaattgtgcgaattgttacacctgggacagtaagcgatgaagcgcttttgcctgaacgccaagacaatctgattgctgcggtatatcaagagaaagaaaaatttggattagccactttagatatgacctctggccgttttcagctttgtgaacctgcggacaaagaaactttgcgtgcggaattgcaacgtattgcacctgtggaattgctttattgtgaagaatttaatgaaatggctgcgattgaacattgtaagggattacgccgtcgcccgatttgggaatttgaacttagcaccgccattacgttattaaatcgtcaatttggcacaaaagatttacgtgcctttggtgtggaaaaatcccctctaggcttaagtgcggctggttgtttattgcaatatgcaaaagaaacgcaacgtaccgcattaccccatattcaaagcattagcttgattcaaaatcaagactgcattcagttagatgccgccacgcgcagaaatcttgaattaacacaaaatcttgcaggtggcacagaaaatacgctagcgtctgtattggataaatgcgtcacgccaatgggcagtcgcttattgaaacgttggattcatcagcctgttcgtgatgtggaaaaattaaaacaacgccaacaatcgattgcggaaattctgaattttgatttagtcgatgaacttcagccttatttgcaattagtcggtgatatggagcgtattttggcacgtgttgcgctacgttcagcacgtcctcgcgatctcactcgcttacgcacggcgttagaacaaattccagcattacgcgcgattgtgcaacaaaaaacaccgccatttttaaccgcacttttcagccaaattgctgatttcagcgagcagtgcgatttattgcaacgtgcattgattgaaacgcctccgcttttaatccgtgatggtggcgtgattgctgaaggatacaatgcagagttagacgaatggcgtatgctctctgatggtgcaactcaatatttggaaaacctagaaaaacgtgagcgtgaaagcacaggcattgatacgctaaaaatcggttttaatgcagtgcatggttattacattcaaattagccaaggccaagcacataaagcacctattcattatgttcgccgtcaaaccttgaaaaatgcagagcgttatattattcccgaactcaaagaatatgaagacaaagtgctgaaatcaaaaggcgcagcgttagcattagaaaagcaactttacgatgaattatttgatttattattaccgcacttaggttcattgcaactggcgagcctcgcactttctgaattggatgtattggtcaatcttgccgagcgcgcagacaccctcaattacgtgatgccaacattctgtgatgaagtgagtgtgaaaattaaaaatggtcgccatcctgttgtggaacaagtattgaaagatcctttcatcgccaacccagtggaactcaatcacaatcgtcatttattagttatcactgggccaaatatgggcggtaaaagcacttatatgcgccagaccgcattaattacattgctggcgtatatcggcagttttgtgccagcagacagcgcgcgaattgggccgattgatcgtattttcactcgaattggtgcgtctgatgatttagcctcggggcgttcaacctttatggtggaaatgacggaaatggcaaatattcttcatcaagctacagcgcaaagtctcgtgcttattgatgaaattggtcgtggtacatccacttatgatggcttatccttagcttgggcttgtgcggaatggttatccaaaaaaatccgctcgcttacattatttgccacccattattttgaattaaccgcattgccagaacagctagaaggcattgccaatattcatttagatgcccttgagcataacaacaccatcgcctttatgcacgccgtacaaaatggcgcagcaagtaaaagttatggtttggcagtcgcggctttggcaggcgtgccacaatccgtcattaaactagcaaagcagaaattgacacaattagaaaaaaactcaagctattcagccgaacagcaaattcaagcgttgcgtgaagccaatcacaatcagggcgaattattctttgaacaagaaacggatgcactaagagaggctattgaaaagctggatcctgatgatttaagccctaaacaagccttggcgtatttgtatcagttaaagaaaatggtggggtaaatattatatcccagcgataaattcaaaggtttatatggattggcggaggggaatgggagttgaacccacccaagaacgctggcgtcctcaacaggatttgaaatcctgccacctcaccggagatgacgcccctccgtggttgaaattgcggtcactttagcgtaaattaattggcaattcaacgttattttaaacggattcaaaaatgaccgcactttttcaacaacttccttccgttgataaaattctcaaaacacctcaaggcttacaactcattaccgaatttggtcacactgcagtcgtggcaacatgtcgagaattattaacccaagctcgtcaatttataaaaaaaaacaatcaacttcctgaatatttttctaattttgaccgcacttttttagaaattcattctcacttacaaaaacaaaaccaagtacaaatcaaagcggtgcacaatctgactggcactgtgttacacacaaatcttgggcgggcactttggtctgaagcagcacaacaggcagcgctttctgcgatgcaaaaaaatgtttcacttgaatatgatttagatgaaggtaagcgtagtcatcgcgataattacatcagtgaattattatgcaaactcacaggtgcggaagcagcctgtattgtgaataacaacgccgccgcagtattattaatgttagcgacctttgctcaaggtaaagaagtaattatttctcgtggcgaattaattgaaattggtggtgcatttcgtattccagatattatggaacaagctggatgccatttagtggaagtgggcaccactaatcgcactcacctgaaagattatcgtaatgctatcactgaaaatacggcttttttaatgaaagtgcatagcagcaattatcaaatttgtggttttacctcttcagtttcagaagaagaactcaccgaactaggtcaagaaatgaatgtacctgtagtcactgatttaggcagcggcgcattagttgatttaagccaatatggcttaccaaaagaaccaaccgtgcaagaaaaaatcgcacaaggtgtggatttggtctctttctctggcgataaattacttggtggcgtgcaagcaggcattattgtgggtaaaaaagaatggatcgaacaattacaagcccatcctctcaagcgtgtattacgttgcgataaagtcattttagctggcttagaagccacattacgtttgtatttaaatcctgaaaaactaaccgaaaagttaccaactttgcgcttactcacgcaaccattaaaacaactcaaaataaatgctatgcgtctcaaagagcggttagaatctcgcttaaattcacaatttgagcttcaaattgaagctagtcaagcacaaatcggtagtggctcacaaccaatggaaagaatcccttccgtggctgttacgattgcagaaaaaacaaacgcaaaactttccgcactttcagctcgctttaaacaactttcccaacctattattgggcgaatggaaaacggaaaaatttggctagatttacgtagcctcgcggatattgaaacattattaaatacattggacgaactatgattattgttacttcaggtcacgttgatcacggcaaaacagcattattaaaagcattaactggcacaagtaccgcacatttaccagaagaaaaaaaacgcggaatgaccattgatttgggatatgcctatctgcctttagaaaacaaagtacttggctttattgatgtacctgggcacgaaaaattcttatcaaatatgctggcaggtttaggtggcgtgcattatgcaatgttaattgtggctgcggatgaaggcgttgcggtgcaaacaaaagaacatttagcaatattacgccaacttcaattccacgaaattattgttgtcatcacaaaagcagatcgtacaaattcagcgcaaatagaatcgttaatccaaacaattaaacaagattatagttttttacgcaatgctaactacttcgttacctcagcagaaacgggacaaggaattagtgaattacgtcattacttagctaatttggcagaattagctgatactcagaaacctttccgctatgcaatagaccgagtattcagcgtaaaaggggcgggtactgtagtaacaggcacagccttttcaggaacagtgaaagtaaacgatgaaatttacctttccactggacagaaaattcgtataaaagcgattcacgcacaaaatacatcaagcgaacaaggtattgcagggcaacgtttagcgttaaatttaaatgctgatttagaccgcacgccaatgaaacgaggcgattggttattgcagaatgagccacttccaccaacagatcgcatcagtgtacaaattttggctgaagtaccattaaatgaaagccagcctgtgcatatttatcacggagcgagtcgcactacgggtaagctcaccttattacagggaaaaaatgccgctaaaaatgaccgcactttagctgaaatcatattagattcaccattattcttggctttcggagacaaacttattttacgcagtggcgatacaaaaaccttaattgccggcgcacgagtattggaaattaactcgccaaaacgtcataaacgaactgaagtgcggttaaatttcttagccaatttagcattggcagagaatgcttcgcaacgtattgcgcttacccttcaacataatgcgacaacggcacgccaattaatgtggacggaacaactgacttccttgcaattagataaagcactcgccgagcgggacgctgtacgttatcaagattggtgttttaatcctaattacgtacaagaaaaaacgcagcaaattttaaccgcacttaatatctatcacgagcaacataatgatcaacttggtgtaagcaaagccagattatatcgaatggcaacattgaatcagccagaaaactaattcatcattttatcgatgaaatgcttgatgatggacgattacaacaaacgcgtggctggattcatctaccagagcacaaaattcagtttaatactgaagaaaaatcacgttggacagatgtattaaacgagtttgaaaaagcaaacggtcaagcgatttgggtgcgcgatatggcaaatgcactcgctattgatgaatcaattatgcgtaattttatgtataaagcagggaaacttggttacctcacgccaatcgtaaaagatagatttttcttaactgaaaccctctatgcttatgcaagactcatcaaacaaatcgcagaagaaaaaggaaaagtttcagtaaatgaagtacgtgataaattgaatttcgggcgcaaacttaccgttcaactgatggaatatttcgaccgaatgggttttttacgtcgtaaaggcaatgaccatattctacgcgataagaatgtttttgatttatgatgtttatgaaatcgccccttacgcagcaggagagcaggatttgttgctctattttgggcaactagaagagttatttaaaccagaatttagacagggtaatgatatttaaatcctttaacttttgaatagcaatcaaaatccctaattacattaaaaatgagagactatagattttgcacttcatttttattacaatagtctttcaatgtaatactaaggagaaaattatggcacttactaattcctctatcagttttagaacagttgagaaaacaaaattagaagcttatcaagttattgaacaatatggacttaccccatcacaagtattcaatatgtttttggctcaaattgccaagactcgctctatccctgttgatttgaattatcttcgcccaaataaagaaaccctagcagctattgatgaattagatagtggtaacgcagagagcttctttattgaagctagtgaaaattattctgccgaagaatttacaaaacgcattcttaatggtggtcaataatgtcagaagagaagccattaaaagtgagctattcaaaacaatttgtaagagatttaactgatttagctaaacgttcccccaatgtgttaattggctcaaaatacattactgcaatacactgtttattaaatcgtttacctttacccgaaaactaccaagatcacgcattagtaggagagtggaaaggttatcgagattgccatattcaaggtgatttggtactgatttaccaatacgttatacaggatgaatttgatgaattgaaattttctcgtttaaatatacactcacaaaccgctttaaaatagaaataatcttaaacaataatccgcacgtaaaatgtgcggattatttttacatagcattaaaactcaaactgaacagacattctgtaatttctgcctggtgcataaaagcggtttaagcctttacctgttgctgtttctactcggttaatggtgccaagatgtcgaatagagcgagcagagtcccaagtgagatattttttattggttaaattatatacaccagcggtaaatgtaagatttttaattggtttccaataggcaatcgtatcgatcactgtatagcgattattacgccataatccgcgagaatcttttacttctttgccgtttgctgttgatgcttccgcatctttttcattgccataaatcttttcttttcgtttaaccatacttgtccattgagaattaaagctatcttttgcttttttggctgcaacattagtgatatacatatccacgccccatttttggcttggtgcatcatagccaatattatataccgatgtggttggttgtaaggcattcattggttgaggtttacgagcaatggcttcgtattctggatgtttatctttattcaattccaaaaattctttatattttggatttaatccattgtctttaattctgcctttttgataggtaaatttatagcctaaatggaaaccttgtagtttttcaaataaatcgcccatctcaagacgtgaagcaatttcgatacctctgactcttgctcgatctcgattttggttctgatggaacggataagcgatagtagagccttcttcaataggacgtggtcctacttctactaagtcaataaaattacggtaatcgttttggaatgcatttaacgtaatataactgctgtttttataaaaagtgaacgcgacttcttttgttttagaggtttccgcttttaaatccgtgttaggctgaatggaaaattgcggatgtttaaatgtcatataaatttcatcagaggttggcgcacgaaaaccattggcgtatttaagctgtacacgaagccaatctgtgggatcaagatttaaccctaaattgtaagaatgatgtttatagtcagttttgcgtaataacagggcaagattgtctttaaaattttttttataacaatctgaattgtaagtgcaatcagtatagtctgcaggcttcgaatatttactgccataaacatagtcttttgggccaaatttcttaaatagcccagtaattaatccattaggaactggaattttttcgtcataactaggcaaatattttacgtggtcatagcgataatttaaatctagccctaaccaagaggtaagttgcacattatctccaaaatacaacacattatttttagtggtaacagggattaaataggtctctttgcctttatcagtattcattaagctacatctgtgactataatcaggtgcaggagtacgcttaccattttcaagtttgttacagaaaaaattgccagcccaccattgcacattggcaacagtgttgtattgatgattcaccatactttttagtgttttttcataaaaaccaccatattttaaactgtgttgggtatgccaaaggctaaattctttatctaaatcaagtttaatttgttgggtgttggtatttaaatcacgatcattgacgaagtctgtactatagccatagctttttgggaataaaaaacgtgcggattcttcttgataaacatcatcccatagtggcgtctttccctttttcagtgtaatttttccatattttttaccattcggtaatgtttcaactatgatatctcgctcttcatactcgtatttatccttcccctcttcatctttttcaacaaaaacctgaaatttgtttttacaatttaatctttcgcaatcaattaagaccgaatcaagtgagcctccagtggaatcaatatcgttatcaacattttcaccattcttattctgaaattgaccataccagccagcgtttttgttgtatgtaagtttatccccatttttatccacaattttataaactccgccttcttctactaaatgtagcccttgtggattacttacaccattacaagtggattgatgacaatactcatcagaacgtgctttattggtgattttttgtgaagaataacttagtttaatatgatcccaaaaaggggtttgactgaaattttcataactaaattgaatattttttcgtttggattgatcgttaataatacgctcaccgtatttttcattgccagctgtactatatggtctaagagcgtaagacaaatctataccctttgtttctaaagtagaatcatctaatgccacactcaagcgatggttttcattaggctgaaagcccagttttattaatgtgctttggcgggtaatttgataaggatcggctttttcacgggtaggaccaaccgctcttaaatccgcctgtttgttgggataaattttataatcgtagttttctatttcgtgcccatcacgcgttgtatcaatgattaaaatatcaaattttttagaacgtcctgctaatgtaagtgtcttaaggttttgattattcattgtttgatagccacgtttataggaaagataataatctttatctatcagataatctcgagcatcttttgtttcaaatataacagagccacccaatgcgccactaccagattttaaggagtcagcacctttggtaatagttgctgttttaacattttcaatttcaatgctattacgagtattattaaaattgccatagccttcaaatagctctttaaatccttgagagcttaaggtttcagcttgacgaagcccatcaaccataatacctacgcggttttcatcaacccctcgaacggcataaccacttgcgcctgttctaccagtttcaactaccgtaatacctgtttcatagcgaacgagatcacgagaatcagaggcctgctgtttcgctaattttttggctgaaatttgggtttccccgacttttttctctttgatattaatattttctgatgaacctgaaacattaatttgttctaattgttcagaaacattactattttggttggttggttggttggttggttggttggttggttggttggttggttggttggttggttggttggttggttggttggttggttggttggttggttggttggttggttggttggttggttggttggttggttggttggttggttgggctgcatagactgtgcttgcatttaatgcaaatgcaatagagcaagcaagcaggctgaatttaaagttggtcataggtttccttaatttttaatgataataattattatacatattaaataattcaatttatttaatcaatatcaaaaaaaagtataataagtacaaaatctaattgctttatatgagcataaaagaaaatcatttttgaccgcacttttgtttgtaagtcatattttaaaattatcaaaatgcaatttttaatcactcttttatcgactgcgtagatttctttcgttataattgagcgtctttttatttaacaaacgtgttcggtgtggattttgaccgagtgcaaattaattgaggtaacaaatgtcattaaatattgaaacaactcaaggtttagaacgccgcgtagcgattaccgttccaactgaaattgtctctaaagccgttcgtgaagaatttaaacgtgctgcaaaaaatgtgcgcgtagatggtttccgtaaaggtcatgttcctgcccatatcattgaacaacgttttggtgcgtcaattcgtcaagatgtattaaacgatttattaccacgtcatttttttaatgctgttattgcagaaaaaattaatattgcaggtcgtccaacttttgctattgaaacttttgaagaaggtaaagacttagttttcactgcaactttcgaggtttatccagaagttaaattacaaggtttagaaaatatcaaagttgaaaaaccaactgttgaaatcacggaagctgacattgataaaatgatcgatgtgttacgtaaacaacaagctacttgggctgaaagtcaagatgttgtaaaagcagatgatcgtgtcactattgattttgttggctctgtagatggcgaagaatttgaaggtggtaaagctactgactttgtattatttatgggtcaaggtcgtatgattccaggttttgaagaaggaattgttggtcataaagcaggtgagcaatttgatattgatgtgactttcccagcggaataccacgcagaaaacttgaaaggtaaagcagcaaaatttgcgatcactttgaaaaaaatcgaaaatatggtgttgcctgaattaacagatgaatttgttgctaaatttggccctaatactaagtctgttgctgatttgcgtgcagaaatccgtaaaaatatggaacgtgaattgaaaaatgcgttagtttctcgtgttaaacaacaagtaatcaatggtttaattgaacaaaatccgattgatgtaccagtttctgcagtagaagaagaaattaatgtattacgcaatcaagcagctcaacgttttggcggtaatgcacaacaaactgcacagttaccgcgtgaattatttgaagctgaagcaactcgtcgtgtacaagtgggtttattattctctgaagtgattaaatctaatgaattaaaagctgatgaagaacgcgctaaagcaatgattgcagatattgcatcagcttacgagcagccagcagaagttgtggaatattacagcaaaaacgaagagttaatgaataatattcgcaatgtagtattggaagaacaagctgttgatgcagtacttgcaaaagcacaagtaacagaaaaagtttcttcattcgatgaaattatgaatccacaagcataataagtaatattattatgattgantaaaagtgcggtcgctctttttaataaaagcgatcgcatttttatttgtgggttatttacgataaaataattagcagttttaatgaaaaaggtaagaaaatgagtgtaattcctatggtcgttgaacagacttcgcgtggcgaacgttcgtacgacatttattcccgtttattaaaagaacgtgtgattttcctaagtggagaagtggaagatcgtatggcaaatttaattgtggcacagcttctttttttagaatcggaagatccaactaaagatattaatatttatattaactctccaggcggttctgtgaccgcaggtatggcaatttacgacacaatgcaatttattaagccagatattcgcactctttgtattggtcaggcttgttcaatgggcgcattcttacttgctggcggaaccgctggcaaacgagctgcgttacccaatgcgcgagtgatgatccatcaacctttgggtggtttccgtggtcaagcatcagatattcaaattcacgcacaagaaattttgaaaattaaacacaccttaaatgatcgtttagcattccatactggacaaggtattgagcgtattgagaaagatactgaccgtgataattttatgtcagctgaagaagcacaagcgtatggtttggtggatgaagtcttggttaaacgttaagggtatataatgacagacaaagataaagatttgcactgctctttttgcggaaaggaaaaaggcgaagtagatagattaattgctggcacagacggttatatttgtaatgaatgtattgaactttgtcactcaatgcttgaagaaagtcatgataaaaatttagaggaaagtgcggtagaaaatgaagaaaaattaccaacacctcacgaaattcgcgctcatctagatgattatgttatcggtcaagattatgcgaaaaaagtgctttctgtggcagtttataatcattataaacgcttgcgaactaactatgaaagcaatgatgtagagcttggtaaaagtaatattttacttataggccctacaggtagcggaaaaacgttacttgcgcaaacattagctcgtcgtttaaatgtaccctttgcgatggcggatgcaaccacattaacggaagctggttatgtgggggaagatgtggagaatgtgttacagaaacttttgcaaaattgtgaatacgatactgaaaaagcagagaaaggcattatttatattgatgaaattgataaaattagccgtaaatcggaaggcgcatcaattactcgagatgtttcaggagagggggtgcaacaggctttattaaaacttattgaaggtacaatcgcttccattccacctcaaggcggtcgtaaacatccacaacaagaaatggtaaaattggatacgtctaaaattctctttatttgcggcggtgcatttgcaggattagataaaattattgataaacgcactcaaaccagtacgagtattggttttaatgccaaagttgaaaaagatgaaaaacaacaatctctttctgaattattccgtcaagttgaacctgatgatttaatgaaatttggtttaattccagaatttattggacgcttgccaatgattgctccattaagtgaattagacgaagatgcgctgatacaaattctcacaaaaccaaaaaacgcattaattaaacaatatcaagccttatttggattggaaaaagtagaattggatttcacaccagaagcattaaaagcaatggcgaaaaaagcacttgaaagaaaaacgggtgcgcgtggcttacgttctatcgtagaagcagtgttgttagatacaatgtatgatctaccgtctcttgagaatttacaaaaagttatcgttgatgaatcgacaattgtagataatcttgcaccaaaattagaatattagatttaatcgcaaaagtgcggttgttttcaccagattttctatgttgatgctattttcaataggcaaggcgaaaagaaaatgctacaatcgcaggttcttatggcattatttttacatttccatttaaaacggattcaattctatggcaaccgaaattgttgataaaaagaaaaatacgcaagaagtgatcgtgaaggcaagtctaaaggtttaaatacattcctttgggttttagttgtgatcttttttgctgctgcggcaattgggaatatttatttccaacaaatctattctttaccgattcgtgttattggtatggctattgcattagtcattgcatttattttagcggcaattactaatcaaggaacaaaagcacgtgcgttctttaatgactctcgtacagaagcgcgtaaagtcgtatggccaacccgtgctgaagcgcgtcaaacaacattgatcgttatcggggtaacaatgattgcttctctcttcttttgggcagtagattcgattattgtgacagtgattaatttcttaactgatttgagattctaaaatgactgaagaaacaacagtatcaaaaaaacgttggtatgtattacaagcgttttctggctttgaaagtcgtgtagctctaactttacgtgaatacatcaaacaacaacaaatggaagatcaatttggtgaagttttagtaccaactgaagaagtagtggaaaatgtagcaggtaaacgtcgcaaaagtgaacgtaaattttttccaggttatgtacttgtagaaatggaaatgaatgatgaaacttggcatttagtaaaaagtgtgccaagagtgatgggttttatcggtggtacaccagataaacctgcacctatttccaaacgtgaagcggatactattttaaatcgtcttgaacaaaatactgataaacctcgtcatcgtaatgaatatcatccgggagaggaagttcgtgtgactgaagggccatttgctgattttaatggtacagtagaagaagtggattatgaaaaaggccgcttaaaagtgtctgtatcaatgtttggccgtgctacaccagttgagcttgaatttggtcaagttgaaaaaatacactaagaaatgattaaaatataaccgcacttttgtagtgcggttttttgtttttaatgtttgttgaaacagcataaaagagtgtttttatacacaaaatttgttgttatttcacaaattaggtagaataatcccatatttatgtaaggattaaaaatgaaaacaaagacaattttgaccgcacttttgagtgccattgcactaacaggttgtgcaaataacaacgacacgaaacaagtgagtgagcgtaatgattcccttgaagacttcaatcgaacaatgtggaaatttaactataatgttatagatcgctatgtgctagaacccgctgcaaaaggttggaataactatgtgcctaagccgatttcttctggtcttgctggcatcgcaaataatcttgatgagccagtcagtttcataaaccgattaattgaaggtgaaccgaaaaaagcatttgttcactttaatcgcttttggattaacactgtatttggactaggtggttttattgattttgcgagcgcaagcaaagaattacgcatagataatcaacgtggatttggggaaactttaggcagttacggcgtagatgctggcacttatattgtgctaccgatttataatgcaacaacaccacgccaattaacgggtgcagtggttgatgcggcttatatgtatccattctggcaatgggttggtggtccgtgggcattagtgaaatatggtgtgcaagcagtggatgcccgtgcgaaaaatctcaataatgcagaattgttacgtcaagctcaagatccatatatcacgttccgagaagcttattaccaaaatttacaatttaaagtaaacgatgggaaattagtcgaaagcaaagaatcacttcccgatgacatactaaaagaaattgattaataaacagaaaagtgcggtaaaaattacccaattttttatcaactaaggagaaaatgatgactcaaattattcatactgaaaaagcaccagcagccattggcccttatgttcaagcggttgatcttggcaatttagttttaacctcagggcaaattccagtgaatcctgcaacaggcgaagtgccagctgacatcgttgcacaagcacgccaatctttagaaaacgtgaaagcaattatcgagaaagcaggtttaaccgcagccgatattgtaaaaacaacggttttcgtgaaagatcttaatgattttgctgcggttaatgcagaatacgaacgtttctttaaagaaaataatcatcctaacttccctgctcgttcttgcgtagaagttgcgcgtttaccaaaagatgtgggattagaaattgaagcgattgcagtgagaaaataattttctgtttggtaatttctgcttaaaagtgcggtcataaactcgcatgtttttgaccgcactttttgtttatctgctgataacaaaaattttacattacaccttgaattttttatgaattttccccactaagggaatacttaaccctaactttgagagaacacattatgatgcgtattcttcttttcttggcaaccaatatggctgtaatgctggtattaggtattattttaagtgtgactggaattgcaggaaatagcaccggcggtattttaattatggctttgctatttggttttgctggctcattaatttccttattcctgtctaaaacgatggcattacgttctgtagatggagaggtgattactcaacctcgtaatcaaactgaacgttggttaattgataccgttagtcgccaagcgcagaaagcgggtattcctatgccagacgtggcgatttatcattcacccgatgtgaatgcttttgcgacaggtgcgacaaaaagcaattctttggtggctgtgagtacgggattattaaacaacatgacggaggctgaagctgaagctgttttagcgcacgaaatttctcatatttccaatggggatatggtgacgatggcgttattgcaaggcgtattaaatactttcgtgattttcttatctcgcgttatcgcaacggcggtagcaagttcgcgtaacaataatggagaagaaacgcgcagttcaggtatttatttcttggtttcgatggtattggaaatgctctttggtgtgcttgcaagtattatcgcaatgtggttctcgcgctaccgcgaatttcgtgcagatgcaggttccgcaagtttagtaggcaaagaaaagatgattatggcattgcaacgtttgcaacaacttcacgaaccccaaaatcttgaaggttctttaaatgcctttatgattaatggtaaacgcagtgaactctttatgagccatccaccactcgaaaagcgtattgaagccttacgtaatctttaaaaattataaaaaatcgaccgcactttaatgaggtcgatgttttattttcctcttttcacccaatatttgaacgggggcttttccacttcacattgcagtaatgtgtgatccataaattgacagaaacttggaatatctcttgttgttgcaggatcgtcagcaataatcaaaagtatttctccatcgttaagatgacgaatatttttacgaacaagcatgacaggttctgggcaacgtaatcctaaagtatctagggtttgtgtgacggaaatttcagacatattcttttttcttttgaaaagcagaaccatatcataccgcacttacggcaaaatttcgacaaatcccagtcatcagtgatagactagtgtcattgaaattaccttgaaaaaagaaatggcggaatacctcgttcctaaaagtgcggttgtttttgaagaagaaattaagaaaagccgttttattacttatttacagcacaccgaaggtttagaagacgcaagagctttttgggcaaagattaaacaagaacatccaaatgctcggcatcattgttgggctgccgtagcaggcaagccaacagattctctacaacttggtttttctgatgatggcgaacctgctggaacggcaggaaagccaatgttgagtgcattgcaaggcagtcaattaggtgaaatcagtgcggtggtggttcgctattatggcggtattttgcttggaacgggcggattagttcgtgcttacggcaatggtgttcaacaagcgttaaagctgattgaaagcgaaattaaagttgaacgaacccttttcaaacttgattgtgactatggtcagttaaggttggttcaacaactttgtgaaaaatatcaggttgagattttatctcaaggttttcaggcaaatattcatttgattttaggtattagtgaaaaaacaatagaggcgttttcttcagaattaacggaaaagtcttcaggtagattagttattcaacttttagagataggcgaatagttgtgcgtattttatcgattatccgaattattggtattcttgtgatgtgtttttcaggtacgatgctagttcctgcatttgttgctctgatttatggtgatgggggcggcaaggcatttatgcaggcttttatgttgagcttgattgcaggtacattactttggtggccatgccatcaccataaacaagaattacgatcccgtgatggttttttgattgttgtggctttttggttagttttaggaagcttggcaacattgcctcttttattgttcgattcaccacatttaactattgcttcagccgtatttgaagcattttctggcttaactactactggtgcaacggtaatgacggggctggataatttacctaaatctattttgttttatcgtcagtttttacaatggttaggtggtatggggattatcgtattggctgtggcgataattccgctgttgggaattggtgggacacaattatatcgagcagaatcttcaggccctcttaaagatcaaaaatctttgcctaaaatttcagaagtggcgaaagctctatggattatttatgcttcattaactgttctttgtgccattgcatattggctatcaggaatgaatctttttgatgccattgggcatagtttttcaacaatttcaaatggcggattttcaacgcacgatgcaagtattggctattttaatcaagcttccatttattgggttacaacaatttttatgctgattggtggtgttaattttagtttacatatttccgcttttcttgcactaggtaaaagaaatatttggcgaaattattggaaagatcccgaatttcgtttttttctaacgatgcaaattatttttattggtattgtatctctatctttatatggttatggtttagtttcagatataaacgaggcagtaacaaaaggtgcattacaattaacatcaatgtcaatgactgctggttatacgatttttgatattgataatcttccgccttttattgggcttttactggtaatttctgcagtaattggtggttgtggtggttcaacaactgggggattaaaagcgatacggacacttatattgtggaaacaaatcgatcgagaactgcatagtttaatccatccaaatttagtacaaccaattcgaataggtaaaaatcgtctagcaccaagaatgatagaaagtatttgggcatttttcattattttatactggtttattgggggtgtgtttttgctgttattctttgtggaatgaatacttttgatgcgatgggagccgtattcgccacattaacgaatgcaggaccgggacttggttttattcacgaaagttttattggtgttccagaaagtgctaaattagtctttagttttgctatgatctgtggacgtttagaaatgttttcattaatcgtgctgtttattccaagctattggaaaaaataataattgaaaaattattgcatttttaaccgcactttttaataaaatgtttatatttccatcaaaagatcatttttttaaatatttttacaaaaagtacttgcaagggatttgaaaatccctataatgcaccgcacacaacgacgccactgttgtgaagttttttaagtttccaagtgcgtcgttattttttgctctttaacaatatatcagacaatctgtgtgggcacttgttgattgacttgttttaaaactatttttaattttgaagtcttaataggtgcttaactgaaaattcatcattacttttttaagtagtgttttatttatagctaagcagtttattgagcgattgaacttgaattgaagagtttgatcatggctcagattgaacgctggcggcaggcttaacacatgcaagtcgaacggtagcaggagaaagcttgctttcttgctgacgagtggcggacgggtgagtaatgcttgggaatctggcttatggagggggataacgacgggaaactgtcgctaataccgcgtattatcggaagatgaaagtgcgggactgagaggccgcatgccataggatgagcccaagtgggattaggtagttggtggggtaaatgcctaccaagcctgcgatctctagctggtctgagaggatgaccagccacactggaactgagacacggtccagactcctacgggaggcagcagtggggaatattgcgcaatggggggaaccctgacgcagccatgccgcgtgaatgaagaaggccttcgggttgtaaagttctttcggtattgaggaaggttgatgtgttaatagtacatcaaattgacgttaaatacagaagaagcaccggctaactccgtgccagcagccgcggtaatacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattgggcttagagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatcctaagaagagctcagagatgagcttgtgccttcgggaacttagagacaggtgctgcatggctgtcgtcagctcgtgttgtgaaatgttgggttaagtcccgcaacgagcgcaacccttatcctttgttgccagcgacttggtcgggaactcaaaggagactgccagtgataaactggaggaaggtggggatgacgtcaagtcatcatggcccttacgagtagggctacacacgtgctacaatggcgtatacagagggaagcgaagctgcgaggtggagcgaatctcataaagtacgtctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccttttggagggcgtttaccacggtatgattcatgactggggtgaagtcgtaacaaggtaaccgtaggggaacctgcggttggatcacctccttactgaagacgagagacagcgagtgctcacacagattggctgatagttgtagacaaatgagcagaagaaaacattacccttgggtctgtagctcaggtggttagagcgcacccctgataagggtgaggtcggtggttcaagtccactcagacccaccactctgagagtgagtgaaacgaaaggtgtagtgtaaataaataataactaagacataaatgattagttattaaattatgatgaaatggggatatagctcagctgggagagcgcctgccttgcacgcaggaggtcagcggttcgatcccgcttatctccaccacttatcattgttaagtaaattagaaaaagacaaattaataaagtattaaggtagtgattaagctattttaaatattaggttattttattcttagttttaagtttaattttaaatttaattttgttttagtttatttaacgatgataactgaaaagttttatcaactgttctttaaaaaattggaaacaagctgaaaacaagagattttcgagagaaagtctgagtaggcaaaacagtaaagtgaaagagagaactgaaaaggaaactctaaaaacaaaacctgttttgtaaaaaaatcttgattgaacaaaagcaatcaagtgtttagttgaatgaaaatacgcatcaaattgaccgcactttgaagtgaaaacgtaaagtgattgaaaacatttgaggttgtatagttaagtgactaagcgtacaaggtggatgccttggcaatcagaggcgaagaaggacgtgctaatctgcgaaaagcttggatgagtcgataagaggcgtttaatccaagatatccgaatggggaaacccagtagatgaagaatctactatcaacaagtgaattcatagcttgttgaggcaaaccgggagaactgaaacatctaagtaccccgaggaaaagaaatcaaccgagatttcgtcagtagcggcgagcgaaagcgaaagagccagtaagtgatagcaatatagtgaggagaatgtgttgggaagcacaatcaaagagggtgataatcccgtatctaaaaaccatattgtggtactaagctaacgagaagtagggcgggacacgtgatatcctgtttgaagaaggggggcccatcctccaaggctaaatactcctgattgaccgatagtgaaccagtactgtgaaggaaaggcgaaaagaaccccggtgaggggagtgaaatagaacctgaaaccttgtacgtacaagcagtgggagcgagggcaaccttgtgactgcgtaccttttgtataatgggtcagcgacttatattttgtagcgaggttaaccgaataggggagccgaagggaaaccgagtcttaactgggcgaatagttgcaaggtatagacccgaaacccggtgatctagccatgggcaggttgaaggttgggtaacactaactggaggaccgaaccgactaatgttgaaaaattagcggatgacttgtggctgggggtgaaaggccaatcaaaccgggagatagctggttctccccgaaatctatttaggtagagccttgaggtgacacctttgggggtagagcactgtttcggctagggggccatcccggcttaccaacccgatgcaaactacgaataccaaagagtgatactcaggagacacacggcgggtgctaacgtccgtcgtggagagggaaacaacccagaccgccagctaaggtccccaagtctatattaagtgggaaacgaagtgggaaggcttagacagctaggatgttggcttagaagcagccatcatttaaagaaagcgtaatagctcactagtcgagtcggcctgcgcggaagatgtaacggggctgaaatatagcaccgaagctgcggcatcagaatttattctgttgggtaggggagcgttgtgtaagcggaagaaggttcatcgagaggtgggctggacgtatcacaagtgcgaatgctgacataagtaacgataaaacgggtgaaaaacccgttcgccggaagaccaagggttcctgtccaacgttaatcggggcagggtgagtcggctcctaaggcgaggctgaaaagcgtagtcgatgggaaacaggttaatattcctgtacttggtaaagctgcgatgtggggacggagtaggttaggttatcgcactgttggatatgtgcgtttaagttggtaggtgggaagtttaggcaaatccggacttccttaacacagagagatgatgacgaggctctacggagctgaagtaactgataccacacttccaggaaaagccactaagcgaaaggctttactaaaccgtactgaaaaccgacacaggtggtcaggtagagaatactcaggcgcttgagagaactcgggtgaaggaactaggcaaaatagcaccgtaacttcgggagaaggtgcgccggcgtagattgtaagggctagcccctgaaggttgaaccggtcgaagataccagctggctgcaactgtttattaaaaacacagcactctgcaaacacgaaagtggacgtatagggtgtgatgcctgcccggtgctggaaggttaattgatggtgtcatcgaaagagaagcacctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagcagtgacgccagtcattgtggaggcgaccttgaaataccaccctttaacgtttgatgttctaacgaagatgacgaaacgtggtctcggacagtgtctggtgggtagtttgactggggcggtctcctcccaaagcgtaacggaggagcacgaaggtttgctaatcacggtcggacatcgtgaggttagtgcaatggtataagcaagcttaactgcgagacagacaagtcgagcaggtacgaaagtaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgtaggatgattgattggggctgctcctagtacgagaggaccggagtggacgcatcactggtgttccggttgtgtcgccagacgcattgccgggtagctaaatgcggaagagataagtgctgaaagcatctaagcacgaaacttgccaagagatgagtcatccctgactttaagtcagtaagggttgttgtagactacgacgtagataggttgggtgtgtaagtgatgtgagtcattgagctaaccaatactaattgcccgagaggcttaactatacaacgctcaagtgtttttgggagctaagtgaagtaagagatgaaaagcgaagcaaataaaagcagagcgaaagagaagtaaaagactaaacaaagaaaagtaaatatagaagacttaatagaaagaaaatcggattcagcttgtgaccaataagaacgagtgaaaggtagaggaaagactgagtaacgagagataaaagagacgagagataaaagagaaaagacgagttatcaaagaattatcctggcggcgatagtgcggtggacccacctgagaccataccgaactcagaagtgaaacgctgtaatgccgatggtagtgtggggtttccccatgtgagagtagggcaccgccaggttaccaaatacttatctaagttaaataaaaacagaagaaccccgtgtcaaaagatatggggtttttgttttttagaagtttatactttaacaaaataagtttagataaagtttatgtttgttagtgagaaaaatacgcactagtgatacaatccacaaaattttaagaaaggtaccctatggctcgtaagaaaaaaacacgtcgaattacagatattatgccaattcgcaaagcagataaaaaaatagatataacaaaagcacgctctggtaaaaagcttacttgttatgaattggatgctaaagctcgtgaagataagaaaaaacgtaagcataaaggtttagcttcaggatctcgtcatagtgcggttgaagaaaaagcgaataaacttcaaaatgaaattaaagatccaaaaattggtagtaagaaaaagataccgttggttgttgaatttgttaataagcctgaaaaaggtcaagtaattcctgtaataaaacaggtgaaaaaacaagatccaatgaaagagcttgaaaatctggaaaataatgaaattcttaatgaattattggatgctttagatgcgggtaaaactattagtaaatcagatcaacaatttgtagatgaatgcttagatcgaatttctgaattaatggaagaacttggcattgaagatgaagatgaaagcgaagatgatttataccgcactttcgagcgtatggatattaatcaatttaggtaatctatgatttggatattttttgtcatcgcacttttcttggtaactggattgactctatatgcaatccgtttattaaagcagttaaaagttcaaaaggaattgattgctaaagctaagaataatcgggttatacgattaaaagagagcattgatattattgctcgtgcaatgcagtctggagaatgtaatctttctgaaggcgtaatgcgtcttacaatgctattaagaccttttggtaagaatttatcatcttatcctgcgatggctaatttatatgaagtggtgcgtgatatgcctacacatgatgaccgtaaactacttgagaaaagagaaagaatgcgtctggatttagctcgagaaagtgcagaagcacagtttgaaaaaaatattaaacaagaattgtatattttattagaagatattaaatctattgagctaatttaaatattataattttaaagaaaaatgcgctaagtctctcctagcgcattttttatgattatttttaacgattttgttcaaaaaataataccgttgctgcaacacgagaatgaacatttaatttacgtaataaattacggatatgtacttttacggtttcttctgaaataaacagttgtgctgcaatttgtttgtttgataagccagttgcaatttgacgaagtacgcccatttcgcgatccgttaagctgtctaacggattatcttcgtgagtacgttctaataataaatttttaatagaatcactcagaatgacttcgccttgtgctatgcgcttgatttgctctagcaatgtatcaggttcagtatcttttaacaaataaccatctgcaccagcatcaatcagagtataaatatcattttttgcatcagacactgttaaaattaaaattcgcgcatcaacgccttctgcacgtaatcctttgagcgtatctaacccagaaagtcctttcatgttgagatctaaaatgatcacatcaggtgatgtttgtaatgccacagaaatcccttctgtgccgctgcttacgtcagccactacttcaaagttatcgtctaattctacaagttgtttaatgccacgacgcattaacggatggtcgtcaatcaataaaacttttagcttatcttgcataatttctcctttagtggttagaagtccactttaaaaagcataacattttataaagaattcaattctatgccaatctagaatagaaaaaaatttgatttatctcaaaaacttactatttgaggtaggtttattgatggataaaaatagaaaaagtgcggtagaaaaatagataattttttaccgctcttttttaagataagaaatattaaatggtcgattctaatgcccaaagttcctgtaaggtttctcgacgacgaattagataggattgatcgccatctactaaaacttctgcagtgcgggctcttgaattatagtttgatgacatacttgctccataggcaccagcagaacattgagcaatataatccccttcagcaattgaaagttcccgttgtttgcctaagaaatcagacgtttcgcaaacaggccctacaacatcataaatggctttttctctttctaaagtgcggtcaatttcgacgatgttcatgtaagcctcatacaatgctggtcggatcatatcgttcattcctgtatcggtaatggcgaaattacggctttcattactttttaagtattgtacttttgctactagaattcctgcatttgcagaaattgctctgccgggttcaagaataatttcaagttcgggataattttttagtttttctaataacgcatttgcgtaatcgcttggatgcggtggtgtttcatccgtataagtcacgcctaaaccaccgcccagatcgagatgttttaatgtaattccatcttcttttaattgttccattaggacaattaatcgatctgttgcatctaagaatggttgtaattcggtgagctgtgagcctatgtggcaatccatccctgttatttttatgtttggtagcgttgaggctaatttatatacctctcgagcttcatttacgcttacaccaaatttattttcttttaatcctgttgaaatataagggtgtgtatgagcatcaacatctggatttacacgtaaagaaataggtgcgattttacccatttctcccgcgatttggttaatgtgcttgagttcagaaactgattccacattaaagcaacggattctaacttctaatgcacgcataatttcttctcgagatttcgcaacgccagaaaagaccacttttgacgcatcgccacctgctgccagtacacgctcaagttcgccttgcgagacaatatcgaaacctgaaccaagttttgccataatatttaacacgccaatatttgagcaagatttcacggcaaaacaaattaagtgaggacgattaccgaaagcagagtcaaaagcgtgccaatgacgttcaagtgtcgcgcgagaatatacatagagaggcgtgccaaattgttcagcaagttgttgaactggcatatcttcggcataaagtttgttatgtttatattggaagaaattcatgttgtgtgcctgttttagttattttgggaatgatattagataatagattattgagtttgttgagcttgatctttttcaggaaaatataaagaaccttttacgccacatcctgtagcgaatatacaagctgaactaagtactaaaattaatagtaattttttcattttttctttctcacttatcggtaaatccgcctttcacaagcttgagaaaggctttataatttgccgcattttatcagatttaaacaggaaaattttatgaatattgcagaatttcaccaaaatattgaacaagtttggcaaaaaattgaagaagaattggaaaaccaaggcgcagatgtagattgtgaaacgcaaggttcmrgtatttacaatcacctttgataatcgcacacaaatagtggattaacaaacaggaaccgctgctggagctttgggattgcaagttaaattaggcggtttccattttgcttttaaaaatggcgactgggtttctaatgacggacaacgtttttgggattgtttcgttgaagcctgtgctgcacatggcgagaacgtgcagttctaaaatgctggattctcctttactatcaaaaataatagaaaaaccgaccgcactttctgttttgaaatcggttttcggttatcaatctttccgtaaagggcaggaagaagttattaatgctgctttaaatggacaagatgcgttggtggtaatggcaacggggaatggcaaatcgctttgttaccaaattcccgcactttgttttgatggtttaactttagtgatttctccgctgatttccttgatgaaagatcaagtggatcagctgcaagctaatggaattgaggcggattttcttaattctagtcagactttagaacagcagcaacaagtacaaaataagcttatttctgggcaacttaaactactttatgtgtcgccagaaaaagtgatgacgaacagtttctttcaacttatttcttatagcaaagtctgctttattgcgattgatgaagcacattgtatttctcaatgggggcatgactttcgccctgaatatacccagcttggcggtttaaaagccagtttccctgatgcgccgattatggcacttacggcaacggcagattatgcgactcaacaagatattctgcggcatcttaatctgaaaaatctgcacaaatacattggtagttttgatcgaccaaacattcgttataccttggaagaaaaatacaaacctatggagcaactgacacgttttgttttggctcaaaagggtaagagtgggattatttattgcaacagccgaaacaaggttgaacgaattgcggaaagtttacgcaataaaggtgtctctgctgctgcttaccacgcaggaatggaaacggcaattcgtgaacgtgtgcaacaggattttcagccgtgataatgttscaagtagtagtcgcaaccattgcttttggaatggggattaataaatccaatgtgcgctttgttgcccattttgatttaccacgtagcattgaatcttactatcaagaaacaggtcgagcaggacgcgatgatttacccgcagaggcggttttgttttatgaaccagctgattatgcttggttacaaaaaattctcttagaaaaaccagaaacgccacagcgtcagattgagcaacataaattagaagctattggtgaatttgcagaaagccagacttgtcgccgtttagttcttctcaattattttggcgagcatcgacaaacaccatgcaataactgtgatatttgccttgatcctcctaaaaaatatgatggtttagtcgatgcgcaaaaagtaatgtctactatttatcgagtgggacaatgttttggtgcacattatgtgattgcggtgttgcgtggcatgcacaatcagaaaattattgaacgccaacaccataaactttcagtgtatggcattggaaaagataaaagtaaagagcattggcagtccgtcattcgtcagcttattcatttgggttttgtgcaacaggttattagtgaattaaatccaacgttgcaacttaaagtgcgaaagtgattttgaaaggcgaagaaccgttagaattggcaatgcctcgtatttctgcaatcagtaaaattgctcataatccacaacgtcaaggtgttgcaaattacgataaggatttatttgcacgcttgcgtttcttacgcaaacaaattgccgataaagaaaatattccgccgtacattgtctttaatgatgcgactttgcaagaaatggcacaatatatgccaacaagcaatattgaaatgctgcaaattaatggcgtgggctctatcaaattagagcggtttgggcagccgtttatggcattgattcaagaacataaggcaattttggcgaatgcgcaaaataatgactaagtgttaaaagtgcggttaaaaatgaccgcactttttgttatacttgcgccaattttttcagttcttagaatttaaggttaaacaatgcgtacaagtcaatatttattttccaccctaaaagaaacgccaaatgatgctcaggttgtgagccaccaattaatgttgcgtgcaggtatgattcgcccaatggcatcaggtttatataactggctaccgacgggtattcgcgtattgaaaaaagtggaaaaagttgttcgcgaagagatgaacaaaggtggtgccattgaggtattaatgccagttgtgcaacctgcggaattatgggaagagtctggtcgttgggatcaatatggccctgaattgcttcgttttgaagaccgcggaaaccgtaactttgtacttggaccaactcacgaggaagtgattacagatttagtccgccgagaagtttcttcatacaaacaacttccacttaatttatatcaaattcaaacgaaattccgtgatgaagtgcgccctcgttttggtgtaatgcgttcgcgtgaatttattatgaaagatgcgtattctttccacactacccaagaaagtttgcaagcaacctatgatgtgatgtatcaagtatacagtaacatttttaaccgtttaggcttagatttccgtgcggtgcaagcggatacaggttcaatcgggggttcagcttctcacgaattccaagtgttagcttcaagcggggaagatgatgttgtgttctcaacggaatcggattttgccgcgaatattgagcttgcagaagcaattgctataggcgaacgcaagctccaacggctgaaatgtgtttagttgatacaccaaatgcgaaaactattgcggagttggtggagcaattcaatttaccaatcgagaaaaccgtaaaaactttgattgtgaaaggtgcagacgaaaatcaaccgcttgttgcgttgattattcgcggcgaccatgaattaaacgaaatcaaagcacaaaaacacccgttagtggcagatcctcttgagtttgcggacgaaactgaaatcaaagcgaaaattggttcgggcgtgggatcgttaggcgcggtaaatcttaatattcctgcaattattgaccgcactgtggcgttaatgtctgattttagttgtggtgcgaatatcgacggcaaacactacttcaacgtgaactgggagcgtgatgtagcaataccaaaagtatttgatttacgtaacgtagtagaaggcgatcctagtccagatggcaaaggcacgcttcaaatcaaacgtggtattgaagtggggcatattttccaactgggtaaaaaatactctgaagcgatgaaagcgaccgttcaaggcgaagatggtaaaccacttgtgatgacgatgggttgctacggtattggtgtaactcgtgtggtggcttcagccattgagcaacaccatgatgaacgcggtatcatctggccatcagacgaaatcgccccattcactgtggcgattgtgccaatgaacatgcacaaatctgaagccgtgcaaaaatacgctgaagaactttaccgcactttacaatcgcaaggcgtagatgtgatttttgatgatcgtaaagaacgcccaggtgtgatgtttgcagacatggaacttatcggtgtaccgcatatggtggtaatcggtgagaaaaacctagacaacggtgaaattgaatataagaatcgtcgtaccggtgaaaaagaaatgattagtaaagataaattgctcagtgttttaaacgaaaagttaggtaatctctaatcagtattttattttgtatattgtgacaaaagagcggttaaaaatagccgctctttttgttgatctaacgtttatattgaacaatgtttaatccaaactaaatgctcgaatataaggtagttttcctttttctaacatctcttgaataccgctttgatggtcattgctgcctaacccccttaattctaaggttatgccaatgctattatcataaacaatttcattacgtgtttggttttggtggtttgtgacattgcgttttacaccaacacttgcagcccaacagcaactgttatattgaacgcctagatattgttctactggtttttgtaaggcgagatcttgataatagcgtcctactacagcccaattattggcaatttcccagcctacaactaatcccacttgttggatatcttgttgataggcgttagcgatttacctaagttttggtcaatatattcttggttcgcatatcgataatttaactgaattaaattatttttttcaggattatattctagtgatgtattcgctaatgatgtcgaattggtatgagtatcaaattgatagctaccacgccaataccatttattacttattttccaattagattctaatgcccaagcagatgatgaagttggtgttttattcgcagggttttcatcaatacgagaattacttaagtaataaatttgacctgcagataaattaaatcgttcttcgccagcaatatcataaaaacgcgttgtgccacccaaggtaacttgatttgccgatgaaattcgatctaaaccactataacggcgatcacggaatagcgaatagtaatcttgctgtactaatgctgaatcgtaaccaaatcccaaataatcattattaagtgttgaaccaatattgctttgatttcggtaaggacgatataaatactgcacgtgcggttcgaaggtttgtgtatactcttttaagaacgttatatcgcgtgccaatacactttgtaaatcaactttaaattgtggaataactcgatttaccgttttttgcacgtcctctgcattttttcctgaaccttttttctgctcgtaacgagtcgcataaagtttcgtttcaatattcaaactgccgtatttatttgacattaaagaatttaggctaggttctgcatggaaacgccatgcagttggcatcaatttactgtcattatcaaaacgaactgcttgtgaatgtaatttgaaatttaaccatccattcgctaaatcatatttgtgatagttgaaatctaattgtggtactgcacggtaagggccgatgtttacaatatcatcaaaaatttggaactgatgtgcagaaagagaaaaattataatttggttgataataagctatgcgagcatattggttcgcataaccatcggtactgcgtccataaatagaatcaaagtcgttgaaataacgtttatcgcttactcgggtgtaattaatatttagacgccaattttgtaaaaagctagaattgtgattccaatagaacaaatgacgttttcgattatcactagcatattcagagtaacgaaccttacctaaatattctcctgccactttaccttcaccaatagaggttaaatagcgaaattccccatttgcttgccaaccacggcgagacatatatttcggggtgaaagtaagatcataattaggcgcgatattccaataaattggttgtgcataccaaagaccatcttggctggatgttcccgcgcttggaatcaataaaccagaacgacgacgatctccaatgggtaattgtaagtaaggggtataaaagacgggaacaccgtgtattttaaagcgagcatgccacatttcagcatattcttctttcacgtattgacgaatttctgacgcatctactgcccaagcattgtcgccgtgcaaacatgacgtaaaggttgcattcttcattacacgataattattatgcagtgttatattatcagctttaccacgtccttgacgaccgacaaattcatattctgaatttgttaaattaccatcgtgactatctaaattaaactctgcatctttacccaacatattgatctgattatctttataatcaaatccattgcggacataagccatgcgtaaaggtgttgattggtttccagattgtttgacctgcacggattgtgctaacaaatggcgattgccttgtttcaaatctacattaccttgataggtcgcatcatttggctgattaatttctgcgttatccgcttcaatatagacaggcagagcattcacatcacccgtcacgacttcaccgctaaattttggcacgcccattaaacattgttcatgcaaatctgccaaactttgttggctataaagtgcggtcaaaatagcaagtgaaattaaagtgtgttttttattcatcgtcttgttttaatttgtcagaaaattggtcagattatactggaaaaagtgcaaggctagtaatatttttcaagaagtgattaatagaatatccactgggttatgattaaattttttgtctattgaaccatcaatacgccaagacagcccatatcttctaacattaaattcgataccccaaataagaatgggtagttgccagaagatgcttgatcaaatttcactaaaatttgagttttgttttttacccaaacggtatctttccaagctaattcttcagcttgtaattgatgttctccttggctttccaccacaaatttggcaccttgaatagtaaatccaacaggtaaacttgcatttaaaatccagcgttcaatggtgcctttacgagccataacatcaaccttgcgtgggtcaaaacgtctttggttaattaagccgtttgtaacatcaatattattctcgagtttgtgcaacggcttgttgtaatattgctggtgcatccgtttcgaaagttagattcggttgtttgttaaatgcggatagttgtccttgagcacgtaattcaaggacggtgttattagcgagttcatcgcctgagaacaacatattttttatttttcgtacaagctacgtttacttccgctaatgagagatacgttgtcaatttcatcatattaaccagtatttctgcgcgttctcctggcgagagaaccaaagatttgactgatttagcttttggtaagaaacctaaatcttgtgcaataagcagcatttcttgatcattatccaagcgtaaatcataagcacgcgctaatgaggcattgagcaaacgtaaacgaatccaaccccgtgcaacatctaaatatggtgcttcaataccatttactaataagcgattgcctacaaagtgcggttgattttgtttgaataattggagaccatcattgttaaattccatatcttgtaaaatcaatggaatatcatctacgccgtatttattgggaagattagcttttaggctttgctcatcttcaattaaccacattccagctaagccacgataggtttgataggctgagttggctaatgtcgcggaacgataccagcagcttgctgcaggttgttcaataggcacgatgggtgcccaagattcgccttttttgagaactcgagctgccccgccaaacagttcgcctgatgcttgtaaaccttgaatagataaagcaactgattgtggcaaattgttatgataattaagtttggcaaagctgcctgatttgattttaatggttgggccaagataattaccgttgaatccccatactgtcacattgtgtgagccatctaacggataattcgtttcctgcatggttaatacaatcgggcgaccgcgacgaacttcaattagtggcggcacaactagtttttcacggcttgccgctaacaatggtgctggcactgtggaaagtgcggtagaaatcgcagctgtttttaataattgacggcgggaaaggcgtggcattttagtttccttttgctatctcttcatcaagttcggcaatgcgtttttccattagatcatgacaataagccgcaagatcgcgaacattgtctttggtatagcctgaaacatcgattggatccattatttcgcaaatcactttgccattatcccaacgatttaaattaattttgttatgcgtgcttgaacacaccactggaataattggtacacctgctgaaatcgctgcatggaatgcacccgttttaaagggtaataaaccgcgaccgcgattgcgagtgccttctgggaacatccaaattgataaattatcttcattaattcgtcgtgcaagctgtgacatcgtattatgtgcttttgtgcggttttctctatccaagaaaatattacccgttacccaatataaaattccgaagaagggtatccaaattaagctttttttacccacgcttactgtacgaggttgcaccatataagagattgttaccatatcataattattttgatgattaccgatataaatggcgcggctaatttgcttctgatcttgaggaatacgatgttctacctttaagccaaaaagtggatataagcgtccaaaccaacgtgcaacaatgcctacgttgcttggatttttaaagcggataaaagaataaatcgtacccagtacacaaattagaatacagcagattaatacgaggaaaattcgaagtagttttaacataaggatgtcctatataaaatttccttgaagtataacaaattcgatctcaatatgtgctaatctaaacaaaaatcgtggaatttttatgaaacatagctattttatttctgatttgcatttaagcgaaactcagccagaattgaccgcactttttgtcgattttatgcagaatcttgcccctcaggctgaacggctttacattttgggtgatctttttgatttttggattggtgatgatgagcaatctgcattgattcaacaagtgaaagatttaattaaatttgtaagtgatcaaggtgtgcaatgttattttcagcacggcaaccgtgatttcttgattggtgaacgtttttcaaaagaaacgggagctcagcttttacctgattatcaattgattacactttatgataaaaaaatcttactttgtcatggcgatacgctttgtattgatgatgaggcttaccaacaatttcgccgtagagtgcatcaaaaatggctgcaacgtttgtttttgtgcttgccattaaaagtgcgggtgataattgcggagaaaattcgagcaaagagtaatcaagataaacaagcgaaatctcaggaaattatggatgtaaaccaagcattcacggcagaaaaagtacaagaatttggtgtaaatttattaattcacggacacacacaccgtgaggcgattcatcaacaagaagaatttacccgaattgtattaggggattggcgaaaaaattacgcatcaattttaaaaatggatgaaagcggagaatttggttttattaaagattagaattgcggtaaagcaaaaactcgttattttacttaatgatactagaataatacttatccataaaatcatacctaaaagctggtggataagcccaacttttagatacagataaaagtgcggttaattttaggattagttttctttcggtaagcgaagcaacgcgtaaattaatcctccccacaataaagtaagggctatgatcatcataataattgcgccagtagtcattttattctcctttagtttcatcaatcgttaatttggtttcgcttttccattttaagcgagaaaggaaacatgccacgacaagtaagctaatcgacattccccaaccaaaggtatttacaaaccagtttggataaccttcataaccctcagagaagacttttgccccttcgctgaaaagcataaatgctaaaacaccactcgttaatacaatgcataaacgccagaagaaacccactttgaaagatgacgtttcgtttaagtgattacctaataaaccgagtttttcatttgctacaatcgcaattaaagacgcaaatgctacggcaacaataccgaaatagttcacaaatttatcgaacacatctaacatcggtaagccagttgttgtgccgaataagatgacagaaactagcatcattggtacacccacgatgaatgtcacttttccacggctaatgcgaattttatcctgaattgcggaaataattacttcgataactgagatgaatgaagtcaatgcggcaaaggttaatgaaccaaagaataacatgccgagcacttcgccaaatggtgctttgttgatgatggttgggaacgcaaaaaatgctaaaccaattccgccttttgctacttcgctgacttcttgaccttgcgctgtagcaataaaacctaatgctgcaaatacgccgatacctgctaacacttcaaagctactgttagcaaaacctacaaccaagccactaccagtcaaatcggattcttttttaagataagaggcgtaagtcaccataatcccaaagccgattgaaagagagaagaagatttgcccataggccgcaatccacacacttggattagaaagttttgaccaatctggcgtaaataatgcatctaaaccttttgccgcacctggtaagaataaggaataaatcacaagcaccataaacatcacgacgagcactggcattaatacggaagagaccttagcaattcctttttgaacacccatagaaagcacgcctaaggcaacaatccacatcgcaattaatggtgcggttaccataccaacaaattcaaagctgataccgtttttaatatcgcccatttttaaaaatttaccgatgaagaaatcaatgggtttatcgccccacgcgccagtgaaagaaaaatatgtgtagcttgctgcccagcctaatactacagcgtaatataatccgatgatgacattcaccatcatttgccaccagccaaacacttcaaagtgcgggctaaaacgacgataagaaagtggcgcaccaccacgatgacggtgcccaatggcataatctaggaataaaagaggaatccctgccgttaataacgcaataaggtaagggatgataaatgcgccaccaccgttttcataagtggtgtaaggaaaacgccaaatattaccaagaccaacggcagaaccaattgctgccagaataaatgcgcgacgaccagaaaaagtctcacgcttttgtgcttttggggctgagtgagccataaattatcctatgtaaaaaaatgaaaagagtttcaatataatgaaatctaatcatcagtcaataaataagccaaaagagcggtaaaaattcactaaattttttaggggaagaacaggaatattcaaaataagccaattttcaccgcactttttttcgtttttttctctccaagccctaccaatgactcgaaatttcgctacaatgctgaacttatccccaaaataaaaacaacaggaaacaaacaccatgacaggcgcacaactcattatggcgtgcttgaaagcacaccatgtcacgactcttttcggctatcctggtggcgcaattatgccaacctacgatgccctttatgacgcaggcttagatcacttactttgtcgtaatgaacaagggactgcaatggctgcgattggctatgctcgctccacgggaaaagtgggcgtctgtattgcaacatcaggccctggtgccactaatttagttattggattaggcgatgctatgatggactccattccagttgtcaccattactggtcaagttgcctctccattaatcggcacagatgcgttccaagaagcggatgttctaggactttcccttgcttgcactaaacacagctttattgtgcaaagtgcggatgttgccctacaaggggatttaatccaagcgcttaatgcgctcaaacaagatcttgatattgaaccttggcgtgaacaaatcagaaatttcaaagcaaaattagatttcacttatgttgaaaatcaaggcaatcgcccgattgatccttgggcattactcaacagcctatctaatcgtaaaccaaataatgcgataatttgtactgatgtgggtcagcatcaaatgtggttagtgcaacacattttacgcgtagcacgtcactgcggatttaccgttacaacaatggaaatgacactcattgaaacccaagtgcggttaaaaatcactgtaaaatctgaccgcactttagatctattagtgaatcagttggttaagctgccggatgttttaatggttaattaagaatattttatcaattaacgaagaaattaatcatacaaacgaaccctaaattttactcggagagattatttatgcccaaactacgttcagcgaccagcacacaaggtcgtaatatggcaggcgcacgtgccttatggcgtgcaacaggaatgaaagaaaatgactttggtaaaccgattattgcggtggtgaactctttcacgcaattcgtaccagggcatgtgcatttaaaagatatgggacagcttgttgccgcagaaatagaaaaagcgggcggcgtagcaaaagaatttaacaccattgcggtggatgatggtatcgcaatgggtcacggtggaatgctttattctttaccaagccgtgatttaatcgctgatagcgtggaatatatggtcaatgcacactgtgctgatgcgatggtgtgtatttctaactgtgacaaaatcaccccgggaatgttaatggcggcaatgcgcttaaacattccgacaatttttgtttcaggcggcccaatggaagcgggcaaaacaaaactttctgatcaattaatccgcttagatttggttgatgcgatgattgaggcagccgatccgaatgtatcagatgaacgtattgatgccatcgaacgcagtgcgtgtccaacttgtggttcatgttctggtatgtttaccgctaactcaatgaactgcttaactgaagccttaggtttatctttacctggtaatggttctatgttagccactcacgcagaccgtaaagaattattcttaaaagcaggtcgtcaaattgtcgagctttgcaaacgctattatgaacaagatgatgcaagcgtattgcctcgttcaatcggtacttttgatgcctttgaaaatgcaatgagcctcgatatcgcaatgggtggttcaagtaacactgttttacacttattagcggcagcacaagaagcaggcgtggattttaaaatggaagatattgaccgtttatcgcgcaaagtgccttgtttaagcaaaattgcaccaaacaccaataaatatcatatggaagacgtacaccgtgcaggcggtattatgggattgttgggtgaattagatcgtgctggattaattcataaaaatacacacaccgtgcttggaatgagcatgggagagcaactagaccaatacgatattattcgcaatcaagatgaagaattacataaattcttccgtgcaggccctgcaggtatccgcacaactcaagcattctcacaagattgccgctgggataccgttgataatgatcgtgtaaacggttgtattcgcaataaagaaaatgcgatttcacaagaaggtggcttagccgtattattcggtaatctcgctgaagacggatgtatcgttaaaaccgctggtgtagatgaatctatttggaaattcactggcacggcaatcgtatttgaaagccaagaagatgcggttgcaggcattttaggtggcaaagtcaaagaaggtcatgttgttgttatccgttacgaagggcctaaaggcggaccaggtatgcaagaaatgttatacccaaccagttacttaaaatcgatgggcttgggcaaaaaatgcgctttattaacggatggtcgcttctctggcggtacatcaggcttgtctattggacatgtttcaccagaagctgcttctggcggtgcaatcggcttagtacgcaatggcgatattatcaacattgatattccaaaccgtgcaattaacttagaaatcagtaatgaagaactcgcaacacgcagagccgaacaagatcaaaaaggttggcagccagctaaccgtgaacgtgaagtatctttcgctttaaaagtattcggtcactttgcgacctcagcggacaaaggtgcggtacgcgataaaacattattaaaataatttaacggttcccctctttcataagagggggataaaacaaaggaaaaactaaccgcactttatcatcaaaacaaacactatgaaaaatctactcaccaatcctcaaccctctcaatcagattatatcaatgccattgttaaacttggttcgcgcgtatatgaagctgcacaagtgacccctttacaaaaaatgggaaaactttctgaacgactgcacaataatatctggattaaacgagaagaccgtcagccagtaaatagctttaaactacgcggcgcttacgcaatgatttctagcctttcagcagaacaaaaagcagctggcgtaatagcagcctctgcgggtaaccatgcgcaaggcgtggcattatcggcgaaacaattaggcttaaaagcattaattgttatgccacaaaacaccccaagcattaaagtggatgcagtgcgtggttttggtggtgaggtgttgttgcacggtgctaatttcgatgaagccaaagcaaaagccatcgagctttcaaaagaaaaaaacatgacatttattccaccattcgatcatccattagtgatcgcaggacaaggcacgttagcgatggaaatgctacaacaagtggcggatttggattatgtgtttgtacaagttggtggtggtggcttagctgcgggtgtggcaattttgcttaagcaatttatgccggaaattaaaatcatcggtgtagaatcaaaggattctgcgtgcttaaaagcggctctcgataaaggcgaaccaacagatttaacccatattggattatttgccgatggcgttgctgtaaaacgcattggcgacgaaacattccgtctatgtcagcaatatcttgatgatatggtattggtcgatagtgacgaagtatgcgcagcaatgaaagatttgtttgagaacgttcgtgctgttgcagaaccatcaggtgcattaggtttggctggtttgaaaaaatatgtaaaacaaaaccatattgaaggcaaaaatatggcggcaattttgtctggcgcgaacttgaatttccacacattacgttatgtatctgaacgttgtgaaattggtgaaaatcgagaggctttattagccgtgaccatgcctgaacaaccaggtagtttcttaaaatttgcttatgtattaggtaaccgagctgtaaccgaattcagttatcgttatgcagatgataaacgcgcttgcgtgtttgttggggtaagaacgacaaatgagcaagaaaaagcagatattattgcagacctcacgaaaaatggttttgatgttgaggatatgtctgatgatgatattgcgaaaacgcatgttcgctatttaatgggtggtcgtgcagccaatgataacgaacgcttatataccttcgaattcccagagcaaaaaggtgccttattaaaattcttggaaaccttgcaaaatcgttggaatatttcattattccactatcgtgcccatggtgcggactatggaaatatccttgcaggtttccaaattgaacaacgcgaacaagcagaatttgnacaggcacttgcccaactcaattatgtttttgaagatgtaacaaaaagcaaatcttatcgttatttcttacgttaatcctataaaaaaggcgtgatatttttcacgcctttgtcttattcaaactctaattccaccgcactttcgccgagtaaattcaccaattccgtcagaatttcatctgttggaatgatcgaccattgcacgcctaaacgtaacaacgcacgacctttcggactttgataatacacgttaataggcaatgttccaccactcactggctcaagtaatgctttaaattgtttaatgaaacttggtgtaatttgatgctcagaaagactaatagccaaggatttgacataacgagaacgagcctcatctaaggtcattaactcgcgcaccgtcattttcaagccaccagagaaatcatcaaagctcacctgccctgaagcaacaatcactgtatctttttgtaatttctcaccaaattgttctaggctttcaccaaataatgttaaatctaagcgacctgaacggtcatccaatgttgcaatacctagacgattgccttttttcgtcatcgcaattctcgatgccacaacgagccccgccacagtgctaatttgtccacggcgatttggtgcgagatctttcaaccgcgtcgatgtgtaatgggaaagttctttcaaataacggctaacaggatggctacttaaataaagccccaaggtttctcgttcgccatcaaggatttgtttttcggtataaggcggtgtattagcataggcattttccacgtcttcatgggtttcagtcagcacaccgaacatatccgtttgtcccattgcttcatctttcgcatgctgatcggaagctctaagtgcatcttccaaattcttagaaagtgcggcgcgatgtgggcctaatttatcaaaggcacccgacataattaggctttcaaaagtacggcggttaatttttttcaaatctacacgagcgcataaatcgaataaatctttgaaaatccccccttcatttcttgccgccacaagtgcttcaatcgggccttcccccacgcctttaatcgcgccaatcccatacacaatttcgccttgttcattgacactaaaatggtgttttccgatattaatatctggtggcgtcacttttaagcccatacgcaaacattcgtcgtataaacctacgattttatccgtattatccatttctgatgtcatcactgcagccataaattctgcagggaaatgagttttaagccaaagagtttggtaagacaccaaggcataagcagcagagtgagatttattaaaaccatagccagcaaatttttccaccaagtcgaaaatcttcatagatagctcgccatcaataccgtttttctcagccccctctttaaacactaaacgctgttttgccatttcttctggtttctttttacccattgctcgacgcaataagtcagccccacccagcgtatagccagccaacacctgcgcaatttgcatcacttgttcttgatacaaaataatgccgtaagtcggctcaagaataggtttcaaacttgcatgttgatattctgcgtcagggtaagatacttcttctctcccgtgtttacggtcgataaagttatctaccatacccgattgtaacggccccggacggaacaatgctaccaatgcgataatatcttcaaaacagtcaggttgcaggcgtttgatcaaatctttcatacctcgtgattccaactggaacacggcggtggtttcggaacgtttaagtaattcaaaagattcaggatcatcaagtggaatggcggcaatatctactcgaggcttgccttcacgcaccatacgaacattaattatatccaatgcccatttaatgatagtaagagtacgcaagcctaggaagtcaaatttcacaagccctgcatattccacatcatttttatcaaagtgagtaactggatgtaagccttcattatcacaatagagtggtgcaaaatcagtaattaaggttggcgaaatgaccacgccacctgcatgtttacctgcattacgtgtcacaccttccagcttgcgcgccatgttaatcaatgctcgcacttcttcatcgctatcgtaggcagtctgtaattgcggctcggtctcaaacgctttggcaagcgtcatacctggatctggcggaatcaatttagaaatacgatcaacgaaaccataaggatgccccagcactcgccctacatctcgaataaccgctttcgccgccattgtaccaaaggtaataatttgtgataccgcgccacgaccataggtttctgcaacgtgctcaatcacgcgatcgcgaccgtccatacagaaatccacgtcgaaatcgggcatagacacacgttctggatttaagaaacgttcaaatagcaaatcaaactctaacggatctaaatcagtgatttttaatgcataagccactaatgaacccgcaccagaaccacgacctggccctactggaatatcgttatccttagaccattgaataaattccattacgatcaagaaataacctgggaaccccatttggttaattacatctagctcaacttgcaagcgttcatcatattttggtcgtttttctaaccgcactttttcatcagggaataaaaaaactaaacgttcttccaagccctctttggatttttgcactaagaaatcttctgtacttaaatcgccagttggaaattgaggtaagaaatattgaccaaggcgcaaagtcacactacaacgttgcgcaattaataaggtattttcgagagcggaaggaatgtctgcaaacagcttacacatatcttcttcactacgaaaatattgctgtgaggtataacatttcggacgtttaggatcgtctaaagtatagccatcgtgaatsstacgcgaatttcgtgggcttcaaaatcctctgtattcaaaaacatcacatcattagttgcgaccaatggtaaatcacaacgttctgctaatttcaacgctgcttgaatgtaacgttcttcatttgggcgacctgtacgacttaatgctaaataaaaatgatcggcaaaaaattcttggtaaaaagcgaccgcactttcaatttcggctacgttttctttcaacaattttttacccacatcgccttgcgttccccctgataaaataatcacgccgtcgcgatgttcaattaaccaatcttgatcaatataaggtaaatcgttataaccgcgttgataagcctttgataacaataaagtaatatttctatagccttcattatttttagctagcaaagtaagatcaaagtattcatcgccacataatgggctttttacttttacatctgccccgataatgggcttcatacccgaagaaagcatttcgctataaaaactaaccacaccacaaaaattagtaaaatccgttaatcccatagcaaccatttcattggcagcacaagctttcacaagaggtttcactttgacgatactgtcaatcatcgaaaaatctgtgtgtgtgcgaagatggatgaagcgaggttgggatgacattgaaaatccttaaagtgcggttaaattttgccgtaaatattaaagcggtattatagcgaatttttcaaacaaatgcttatgctacaaatagtgttcccaaattggctcggataaccgattgcgtgaataaaaaatgttaagtagatcaaaaaattgataattagccgttttcatttngttagatttccgctagtctaacgacgattttttatttatttcaacgaataaggataacgctatgacaacactttnggaggttgcacaacattggttaaaccaagatcctgacgcagnaaactcgtgcagaattaaccgcacttttagatgccgcaaaaggcggagataaagcggcagaagcagaattacatgcgcgttttgatggtcgcttacaatttggtacggcaggtttacgtggtcgtttacaagctggctcaatggggatgaaccgagttttagtttctcaagctgctggtggtttagcggaatatttaaaaggttacgataaagaaccctcaatcgtcattggttacgatggtcgtaaaaactctgatgtttttgcccgtgacaccgctgaaattatggcgggtgcaggcgtaaaagcttatttattaccacgcaaattaccgactccagttttagcctatgctatccaatattttgataccactgcaggtgtaatggtaacagcaagccataacccaccagaagataatggctacaaagtgtatttaggtaaagcaaatggtggcggtcaaatcgtttcaccagcagataaagacatcgcagcattaattgataaagttgcggctggcaatatccaagatttaccacgtagcgataattatgtggtgttaaatgatgaagtggtagatgcgtacattacaaaaactgcatcattagctaaagaacccgcttgcgacattaactatgtttataccgctatgcatggtgttggctatgaagttttaagtaaaacactggcaaaagcaggcttaccacaaccccacgtagtcgcagatcaagtttggccagatggcacattcccaacggtgaatttcccaaatccagaagaaaaaggcgcattggatttagcaattaaagtggcaaaagaaaagaacgctgaatttatcattgctaatgacccagatgcagaccgtttagccgttgctgtgcctgatgcgcaaggcaactggaaatcactacacggtaacgtggttggctgtttcttaggttggtacttagcaaaacaatatcaaggtaaacaaggcacattggcttgctcacttgtttcttctcctgcgctcgctgaaattgcgaaaaaatacagtttccaatcagaagaaaccttaactggtttcaaatacatcggtaaagtatctggcttattgttcggttttgaagaggcattgggctatctagtggacccagacaaagtacgcgataaagacggtatttctgcagcaatcgtgttcttagatcttgtgcgtaacttgaaaaaacaaggcaaaactttagcagattatgctgatgaatttaccaaagaatttggtgcttatgtgagtggacaaatctctattcgagtcagcgatctttcagaaattggaaaattaatgaccgcacttcgtaacaatccaccagcagaaatcgctggcgtgaaagtggcacaatttatcgaccacattaaaacagatcgtcaaagcgatatccttgtatttaacttggaaaatggcggacgcttaattgctcgtccttcaggtactgaaccaaaaattaaattctacttagatgcgcgcggtaaagatccaaaagatgcagatcgcgtactagcagaatttgatgaaggtgttcgtcacattcttcgccaagatgcttatggcaaacaagactgctaattgcaaaatagtaagaaaaaacaccgcttgtaaaagcggtgtttttgcatttaagcacttttgctgtttaaaattttccctaaattcgtttccaaccaatccaccaactcaaacatcttattagattcctctctcccaaattctgttaatgtgtaatctacttgtggcggaacagtgttgtaggatttgcgaattacgtaatggttggtatacagaaaactacactgaatcagttccaactacattagcaaacaatgctttctatggttcagtagaaaacggaaaaatttcatccgcacttcgtgcagaacttgctgaagctgcagcggattatgccgtagcacttgtacaagtaggattaggtgaaggctttgcaggcttaattgcacaatgggatatggatacgtcaaacggtgcattgacttgttgtttgaaaagggtgtggtatttggtcataaaaaatctgcaccttagttagttggttatttaatccagcttttggggtgcagatcattcctagcttgccttttgttttaccatttaattaatgtttagtttgttcttcctcagatttttcttctgcattttctgcttgttggcgattcatatattcaacaaacaatgcatcaaagtttactggagataagtttaatgcagggaacgtaccgcgatttactaggttagacactaattcacgcgcataagggaaaagcatattcgggcattgagaagttaaacaatgcgccatttgaacatcttctaaaccgctaatagtaaatacgcctgcttgtttaacttcgcaaataaatgcgacatcgccactatcttcaagtgtagtttcaacagaaatgtttaataccacttcatataagtcatcgccaacttgggttgtttcggtgcttaaatcaaaaccaagttttggtttccattcttgttggaaaatatgtggaagatttggagcttcaaaagacacatctttcacataaatacgttgaatttggagaacgggttgttgttcttctgttgctgcaacgtcttgtttttgntctgacattttctattccttattatttatgttttttaactaaaggtaaatttgctgctacccacgcggaaaggccttctttcaacacaaatacagaattaaaaccttgtttggttaaaaatactgcagaagcagaggctgaagtaccatttgtatcgactaatataagagcgttctctttatgcgactctaattttccgatattttgatttttaatttcgcttggaagcacattaatactattaatgatatgtccacgttgaaattcttcaagactacgtaaatctaccacaatggcttcatcggaatttattaaccgaataacttcattgtgcgtaattactttaaatttactcgttgcgcctttgtagaatgtataaattaccattacgaaaatcgcaaaccaagaaactgctaaaagcgtatgtttttgagcaaactctgttgccattgagataaattcttgcattgttttctctactgattaagtacgtcaaaatagggctcaagtataaccgcacttgggttatctttcaaaaaaattatgcttaaattccgtacttgcataaaggttatacaatcaacaaaaaaaattatgtgatcgagatcataaatttgtttttccattgtttataaataacttaatttagttagactactttggagaaatttttattcatcttaggagaaatctatgaaattaactaaattagccttatgtactttatttggtctaggtgtttcaatagcaaatgcagctgacttaccaaatattacaatcttggcaacgggtggtaccattgcaggaagcgggcaaagttcggtaaattctgcgtataaagctggacaattaagtattgatactttaattgaagctgtaccagaaatgaaaaatattgccaacattaaaggtgagcaaattgtaaaaataggttcacaagacatgaatgacgaagtctggctaaaactggcaaaagccatcaatgctcaatgtaaaagtactgatggatttgtcattacccatggtacagataccatggaagagacggcttatttcttagatttaaccgtaaaatgtgaaaaaccggttgttctcgttggggcaatgcgtcctgcaacagaaaaaagtgctgatggcccattaaatctttacaatgctgtcgttgtcgcagcagacaaaaaatcaagtggtcgtggtgttttagtcgcaatgaataatgaagtactaggtgctcgcgatgtaacaaaaaccagtacgaccgcagtgcaaacgttccattcaccaaattatggttctctaggctatattcataacagcaaagtggactatgaacgttccccagaaagcaaacataccatcaacactccgtttaacgtagaaaaattagatagcctacccaaagtggggattatttatgcttattcaaatgcacctgtcgaaccattaaacgcattactcaatgctggctatcaagggattgtatctgcaggagttggcaatggaaatgttaatgctgcacacttagatcgcttagaaaaagccgcaaaagatagcgtcgttgtagtccgttcttctcgtgtaccaacgggttatacaactcgtgacgctgaagttgatgatagtaaatatggctttgtagcatcaggtactttaaatccacagaaagcccgcgtgctcttgcaattagctttaactcaaactaaagatccnaaagtaattcaacaatatttcgaagacttctaagatcaatggtaataaacaaagtgcggttataaataaccgcacttttgaccacaatttattgatccaagttatggaatctctacctatttgttgctatattacacgccgtttcaacaaataaaacacagtgttttttattaacctaggggggcagtatgtctgcaatgtttttactacaatttgccatcgtattattgtgtatctttgtgggtgcgcgtgtaggtggtatcggtttaggtgtatttggtggtttaggtcttgccattctttcttttggctttggcttgaaaccagcaggtttacctattgatgttatgtttatgattatggctgtagtggcagccgcggcagcaatgcaagcagctggcggtttagactacatgatcaaaatcgcaaccaaaatcttacgtcgtaatcctaaacacattacgtttattgcgccagcagtaacttggttattcactctcttagcgggtactggtcacgtggcatattctgtattgccagttatcgctgaagtgagccgtcaaaacggtatccgtcctgaacgcccaatgtcaatggcggtaattgcatcacaatttgctatcgtagcaagcccaatcgctgcagcggtggtggctgtggttgcttaccttgagccacaaggtattcatcttggcgatgttttaatggtaaccattccttcaactattctaggacttttccttgcttgcttatttgttaataaaatgggtaaagaattaaaagatgatccagaatatcaacgtcgtttgaatgatccaaaatatgcagatatttttgcttctaccacttcagtcaaagaagtagaagtgagcaaaacagctaaaatttccgtttctttattcttatttggtgctttacttgtcgtgttaatgggtgcagctccttctattcgacctgtttttgatggaaaaccaatgggaatggcacataccattgaaattattatgctttctattggtgcattgattatcttaacttgtaaaccagatggcacagcgattaccaaaggttctgtattccatgcaggtatgcgtgcagtaatcgcaatcttcggtattgcttggttaggtgacactttaatgcaggcacacattactgaagtaaaagaaatggtgaaaggcttagtggaaactgcaccatgggcatttgctttcgctctatttgtactttcagtattagtaaacagccaaggtgcaacagtagcgacattgttccctcttggtatcgcattaggtatccctgcacctgtattaatcggtgtatttgttgctgtaaatggttacttcttcatccctaactatggtccaatcattgcatctcttgacttcgataccacaggtacaaccaaaatcggtaaatacattttaaaccacagctttatgcttccaggtttattgagcatgtttttctgcttattaatcggtttaggtctttcgcacgttattctttaaaatgtgattcgataacaaagaacggtgctgaaatagcaccgtttttgttgttctaatatcaacttaaaataactcaaaaaaataaccgcactttgatatataagtgcggttatttttatgaaagttttccgccctgtttcgttgttatgttatcattacattaatgtaacatttttaacaatttaaacttttaggagagctttatgaaaaacgtcgtgatcgttggtgggggtgctggcggtattgaattagcaacatttttgggtaataaattaggtcgtcaaaaacaagctaaagtaacgctggttgatcgcaatgccacccatttatggaaacccttattgcatgaaattgcaacaggcgtaatggatgatggcgttgattctttaagttatcgtgcgcacggtaaaaatcattttttcagttttgagcaaggttcaattatacgtattaatcgcgagcaaaaatatgttgaacttgcacctgtttatggacaagagggcgatatgcttgtcattgctcgtcgaattccttacgattatttagtgattgccattggcagtaaatctaatgatttcaacacaaaaggggtggctgataattgtatttttttagatagttcaaaacaggctttacgttttcaacataaactgttggaattatttttaaaattttcagaaaaccgcgcattagatgacattggcgaagaagaatttaaacaaaagttagtggatgaaaataaagtaaatattgctattgtgggaggtggagcaactggtgtggaattaaccgcagaactttatcatgccgctgaagatttgtcttcttacggttatggtaaaattgatagttcttgcttacaagttactttagtcgaagcaggaacacgtttattgccagcattacctgaaaatttatctgctgcagtgttagatgaattaaaggaaatgggcaccaatgtgcaattaaacacaatgattactgaggcgcagccaaatacacttattaccaaagatggcggggagattaaggctgatcttattgtttgggcagcaggggttcgcgcctcaacagtaacgcagcaatttgatggattagaaattaatcgtatcaatcaattagtggttaaagatacacttcaaactaccgttgatgatagtatttttgcgattggcgattgtgctgcattaatacaatcaaatggtaaattggttccgccaagagcgcaagctgcacatcaaatggcaaaggcttgtgcaaaaaatatttttgcattgtttgaaaataaaccactgaaatcttttaaatataacgataaaggtactttagtttctttgtcaaattttaccgcacttggtagtctaaccaataagtttggtaaaaatccacttaccgttcaaggtaaatttgcgcagtttgcttatgtgtctttgtatcgaatgcaccaacatgctttgcacggttgtattaaaattggtttgattattctcgttgataaattgaatcgttatttaaaaccaagattaaaattgcattgattaagtataatttttcgttaaatgcgatctaaatcatttatataaaagaaagggcatcaatgatgccctcagtattgttttatgaagaaagatcttcggatttttcaattgttcctttcaccgttaagcaaatttctgttgaaatcaaatgggaaagcgttgaagctaattcttctattttatcaagaacagtataaccagattcatcaaagtaacgttgctctttcaagtttgcaataaagcttgaaaaaaccgctttatcaaagaattctggtgcatttatgccgtgtaatactgataaacgttgagcaacaagctggctttctttttcaagttcagctcgagaaatagcaggttgtttttgtaaaatagtgacagtaatgtaataacgttgcaagatttccagcattcccgcagaccaaagctgtaaaattcgtacttttgatttattaatagataagaagttatcatttgaattaataacgctttggcgtgcaaattcattaatgatttgatggatttgtacattcaattcatcttcattgaaatgtaagaacaattcgccttgtaagaaagggtaaatttttctaattgcgtctaataataaatctttttggatcgcttcgtaatgcaaaataatactcgcaactaaagatggtaatacgaatagatgctgaatattattacgataataagtcattagtacagcagatgaacgttctaagcgtacaatttcgccaaaattatctttttcaattaacacacctatacgatctaaagccaatacgtgttctaacattgcttgcggtgtcacatttggtagcactacgtccgtagaataagggacattttgtaacaattgttgataactactaagttgttctaacagttgctcacgtgaaagtgctcgctgacgagatgaaagtagtgctgtacccacaaggttcattgaattaactgccgctgctttgttaatattaatcattacttgtttagaaatattatttaccgcaggtgtaaaccattgtggtttttcttcgtgattttgctctttccaatcaggaaaatgttggctcaaatagtttgaaagcgtaattggctcaccaaaatttacaaaaccttgaccaagattacgtaattttttaattacacgaagtactaaacccgcattttctttttctttcgctgcaccacgtaattccttagcataagtgtctacttctaatacgtgttcataaccaacgtaaacaggaacaatcgaaatggggcgagtttgactatgttgcaatgcttgaagtgtcattgacatcatacctgtttttggtgccagcaaacgacctgtacgagaacgaccgccctcaataaaatattcgacggaatagcctcgatggaatagttctgataaatattcgcgaaaaatggcagaatatagtcgatttcccttaaaagtgcggcgaataaagaatgccccccaactacgaaacattctacctataggccagaaatttaagttaatccctgccgcgatatgtggcggaacaagaccttgatgataaagcacataagaaagcaataagtaatcgatatgactacggtggcaaggcacataaacaatttcatgaccttctaacgctaatttacggacacgattcgaattttgtacattaatacctgaataaagtttattccaaagccaacgtaaaaaacgatctactgcacgtaaacttgaatggctgacatcagctgcaatttcatccaaaattttatatgcttctttttgtgctttttcaatactgatattttttgattttgcttcatcttcaattgctcgtcggattgcttctgattgcaataatttattaaacattgcttgacgatttggtaaacgagggcctgtcgctgaaatacgttgttttgcgaagtgcatttttgcaactcgagccagcttttgtgcaattttttcatctgagccatgttcaactaccatataacgtaatgaaaccgcttgagaaaaacgcacaaaagtatcacgtccaaaccaaattgctgcaaatgttttttgtataccatttaataaacgcaaattaggcaaatctgatttatcttcttgtccgggagaacgtccccaaagaacagaaacaggaataagttgcacatctaaactttcagaagtgcggtgtaattcaagatatttattgaaaatggtagtggtttcgtctttcgcaccttttgatttaaaaattcggcgaccttcgtctaaatatacataacgtggtaacttaacgccattaatttcatttttctctgcgggatcgggcaagcctaacgctaagcaatttcggcggaaaataacgaaatcagtttgagatgtataaggcaaaacataaacaataggttgatgaatattaagtgaaagctcttctattggattggcgggaataggattatttttcaccaatgcagacagcggcaagctcaataattggcgatacatatttataaaatttgccataataaattttctctttgttataagtttgtagatcttatagacgtttaaaaagcagtttgtgaatagaactatttttagccctttggtgtttttatcgtccaaaaactcaaatattttaacacatccgatctcaactaatttagaaaatttggcgacaaaatgtgacttaatacacagatttaaaaaataacagttgcaactttacacaatctgtatacaataccagttatctgtgtttaaaaacaggagtgtatatgagaccattaaccgcacgccaacaagaagtgttggatttattaaaacgccatttggaaacaacaggtatgccaccaacacgagcagaaatatctcgagaattaggtttcaaatctgcaaatgccgcagaagaacatttgaaagcactttcacgtaaaggtgcaatcgaaatcattcccggcgcatctcgtggtattcgtattttagacaatagttcgaatgatgaatttgacggtttaccgcttgtagggcgcgtacgtgctggagaaccgattcttgcagagcagcatattgaagcgacatatcgagtagatgcagatatgtttaaaccacaggctgacttcttacttaaagtttatggtttatcaatgaaaaatgttggtatcttagatggtgatttattagctgtgcatagtactaaggatgtacgtaacggacaaattgtggttgcacgtattgaagatgaagtaacagtaaaacgtcttgagaaaaaaggttctatcatttatctacacgcagaaaatgaagaatttgatcctatagtagtcaatcttgaagaacaaaaaaattttgaaattgaaggtattgcagtaggcattattcgtaataacgcttggatgtaatctgataccaaggaatgaataaagtgcggtaaaaatttacggtatttttaccgcactttgcttatactagagttctttatttgccatgatttttgctgctctttataatgcaaaaatcttgaatttatacaaaggatggaaaaatgcagttttccaaaatgcacggattaggtaacgattttgttgtggttgatggagtcactcaaaatgtgttttttactccagaaacgatccgacgtttagccaatcgccattgtggaattgggtttgatcaacttttaattgttgaagctccttacgatcccgaactcgactttcattatagaatttttaatgctgatggaagcgaagtttcgcaatgcggaaatggtgctcgttgttttgctcggtttgtgacattaaaagggctaactaacaaaaaagacatctcggttagcacacaaaagggtaatatggttttgacggtaaaagatgacaatcaaattcgtgtgaatatgggcgaaccaatttgggaaccagcaaaaattccatttaccgcaaataaatttgagaaaaattatattctgcgtacagatattcaaaccgtactatgtggtgcagtttcaatggggaatcctcattgtgttgtacaagtagatgatattcaaacagcaaatgttgaacagcttggtcctttgttagaaagccatgaacgttttcctgagcgtgtcaatgctggttttatgcaaatcatcaacaaagaacatattaagcttagagtttatgaacgtggtgctggcgaaactcaagcctgtggaagtggtgcttgtgcagctgttgcagttggcattatgcaaggcttattaaacaacaatgtccaagtagatttaccgggcggttcgctcatgatcgaatggaatggtgttggtcatccactttatatgacaggcgaggcgacccatatttatgatgggtttataactctttaatatttttccccacttatcttaaaaaagatgaggcgtttttcttaaattagcgtaaacattttgtatctaaatatatttttattgaactgtttgataactttaagtaatcagaacaagcatttttcatacaatctctagattttttactcaaagaaatagattattagcataataaaaaaaccgcctctcggcggttcttgttttaaatcttctatctactacgctaacactgccaatgcagcttcatagtttggctcttctttaatttcttcaactaactggctgtgtaaaacattgttttgttcatctaacacaataaccgcacgagaagttaaacctgccaacgggccagtttgaatatctacgcctaattgtgagtgtaatgcgtggttacgaaaagttgaaactgttttggcattttcaatcccttctgctccacaaaaacgagcttgagcaaagggcaagtctgctgaaatacaaagcactatggtgttacttaattttgccgcttgttggttaaatttacgtactgaagtcgcacatacacctgtgtcgatgcttggaaaaatatttaggaccttgcgtttacttgcaaaatcgtttaatgcaacatcggctaaatcattaccgactaaaataaagttttctactatttcgcccacttgagggaaatgtccgccaacttcaatagggtttcctgctaatgtaactgtcataaaatcctctttatttagattaagtgaaaagtgtttaaactataccacgctttctaattctttccaccaattaaagctatccagaatttgattttcgggaaaatttcagccaccacacaataaccaatagcaaagactaatgaaaacagtatgtgcgttaccccaatccagttaaatccgtgaaatcaatagggctgcgcggtggaaaagaatgctccgctccccatttaacgaaagcagagataaaacctgcaaaaaattgcaacgccctaacgacgtttagatggttctgaaaataagctcattgttatgtccttaaattaattaaaagtataaaaatttccgagtttatgaaagtgtgtaattttacgtctgttatatcacattatcaaacaaaaatacttcaattgggttatctttggctggctgttcataaggttttaaaatttattagcaatagataaagtaattgattgattttttagcggttgtagagagggtataagctttgtattacaaaatcttttttttgaaaatagggagtatgtttgaacataaatcttattgttttattttgaatgcaaacgtttgctttgttcgttataatacgtctgtttttttatttttcttttatacggaactgcaatatgactgtcaaaacctttcgtggctcgcctgctctttctgaatttcgtttaactcaacttcaacaaaaatgccagcaatatcaattgcctattacgtcagtttatgcagagtatttgcattttgttgaacaaaaaacatcgcttgtagaagatgaaatcgttaaattacaagcattattgcattatggatcaatgttttctgaactcaagcctgcaggatattgtttaattgtgactccacgagtggggacaatttcctcttggtcttcaaaagcgacggacatcgctcacaattgtggtttgtcgaaggtaaatcgtattgaacgtggtatagcctattacttcaatattgagcgtgatttaaccgaagcagaattggctacgctgaaagatttattacacgaccgtatgttagaaaccgtgttaaatcacgaaacagaagcagccttgctttttactcaacaagaacccaaagcattaactacaattgatattttaaatggtggccgtcaagcattagaacaggcgaatattgccttgggtttagcgttggcagatgatgagatggattatttagtggaaagttttactgccttaaagcgtaatccacaggatgtggagctttatatgtttgcacaagcgaattcagagcattgtcgccataaaatttttaatgccgattggattattgatggcaaaaaacaggataaatcgctgtttaaaatgatcaaaaatacctttgagcaaacgcctgattttgtgctttctgcttataaagataatgctgcagtaatggaaggttcgaaagtcggccgttggtttcctgatcctgatggacaatatcgtgttcatcaagaagatgtgcacattttaatgaaagtagaaacacataaccatcccacagcaatttcgccatttcctggtgccgcaacaggctctggcggggagattcgtgatgaaggggcaacggggcgtggggcaaaacccaaagcaggtttaacaggtttctcggtgtctaacctcgttattccaaactttgaacaaccttgggaaaatccattgtctaaaccaaatcgcattgcttctgccttagatattatgatagatgcgcctttaggtagtgcggcatttaataatgaatttggtcgcccagcattattaggttatttccgtacttatgaagaaaaagtaaatagttttgctggaaaagaagtgcgcggttatcacaagccgattatgttagcgggaggaatcggtaatattcgtggcgaacaggttcaaaaaggcgaaattccaatcggtgctaaattgatcgttttgggtggggcagcaatgaacatcggtttaggtggtggtgctgcttcttcgatggacagtggtaaatcaaaagaagatttagattttgcttctgttcaacgtgaaaatccggaaatggaacgccgctgccaagaagttattgaccgctgttggcaattaggcgaagaaaatccaatcctgtttattcacgatgtgggtgcgggtggtttatctaatgcaatgcctgaattggtacacgatggcaagcgtggaggaaaattcgatctgcgttctattctttgtgatgaaaaaggtatgtcgccattggaaatttggtgtaatgaatcgcaagaacgttatgtattagccgttgcgccagaaaacctcgaattatttaccgcactttgtgagcgtgaacgtgccccttttgcagtgattggcgaagcaacacaagcagaacatttaatcttgcacgatagtcatttcgataataatccaattgatttaccaatgaatgtgttattaggcaaaacgccgaaaatgacgcgtgaggttttgtcaaaaacagtggaaaatcaatcacttaaaatagaaagtattcaattaaaagaagcattccaccgtgtattacgtttacccgttgttgcagaaaaaactttcttaattactattggtgatcgctcggtaacaggaatggtagcccgagatcaaatggtgggtccttggcaaatccccgtgtctgatgtggctgttactactgcttcactggatagctaccacggcgaagcaatggcaattggcgaacgctctccagttgccttgctagatttctcggcttcggcacgtttagctgtggcggaggcgattactaacattgctggcaccctaattggcgagatgaaacgtattaaactttctgccaactggatgagtgcagcaggtcacacaggcgaagatgctggactttatgaagcagtaaaagctgtgggcgaagaactttgtcctgcgttaggcttaactattcctgtgggtaaagactcaatgtcgatgaaaaccacttggatcgataatggcgaacaaaaatcagtgaccgccccgctttcattagtaatttccgcttttgctcgtgtagaagatgtacgtaaaacgcttacgccacaacttcgtaccgacaaaggtttctcgagtttattgctaattgatttaggcgaagggcataatcgattaggtgcgaccgcacttgctcaagtgtacaaacagttaggagacaagcctgccgatgtggtaaaggttcaacgcttaaaagatttttacaatgcaatgcaaactttagtggcagaagataaattattggcttatcacgaccgttcggacggcggtttaatcacaactcttgcagaaatggcgtttgcagggcattgtggggtagaagttgatatttcagctttaggcgacaacgatttagcggtattatttaacgaagaattgggagcggttatccaagttgccgatagccaattagaaagcgtacgtgaggtgttgaaagctcacaatttgcttggtattatccaccaattaggtacggtaactgctgatgatcgctttgagatcagccgcggcagccataaattattcagcgaaaaacgctctgaattacgtagtatttgggcagaattaacttaccaaatgcaacgcttacgcgataatccagagtgtgctgagcaagagtttgaagctaagaaaaaccctgacgacaaaggcttatccgcatttttgacttacgatgtgaatgaagatattactgcgccatttatcaataaaggtgtaaaaccaaccattgcaattttacgtgaacaaggtgtaaatagtcattatgaaatggcagcagcgtttgatcgagcaggctttaatgcaattgacgtgcatatgtctgatttaatgattggtcgtcgtaatttagccgaattcaatgcaatggttgcttgtggcggtttctcttacggcgatgtgcttggcgcagggggcggttgggcaaaatccatcttatttaacccgaaattacacgagcaattcagccagttttttatcaatccaaacacactgaccttaggcgtatgtaacggttgtcaaatgatctctaacttggcggaaattatcccaggtacagaaaactggccgcattttgtacgcaacaaatctgaacgctttgaagcgcgtgtgagtttagtgaaaattaatgaagtggattcagtttggtttgcaggaatggctggctcacatatgcccattgcggtttctcacggggaaggacaagttaagtttaaatcagttgaacagtttgcaggcttaaaagcacaaggcatcattgccgcacaatatattgacaacaacggtagccccaccgaactatatcctgccaatccgaatggttcttcggagggcattactgcaattacaaatcttgatgggcgagttgctattatgatgccacaccctgaacgtgtgttccgtgctgtgagtaactcttggcacccagaaaactggacagaagacggtgcgtggatgagattattcagaaatgcaagaatggtattttagagaaataaatggacttgaaggttaaaaaagtgcggtggaaatctggcagattttcactgtgcttcggtgttttcaattttatgtaattgtttttagttgtgtttttgtttgatgatttaattatttttattgttaagttagcgatataatcatcaaaatagaaatatagaaatgattaatatgaaacctcaatattatcttggtatgatgtcgggtactagcttagatggcgtggatattgtgttggttgatttttctcaagatcctcaacttatcctatctgatttttttcctatgccagaagatttgcgtgagaaattaaccacacttattcaagtaggtgaaacaactctacaaaatttaggcgaactggatcataaacttgccttgctatacagtgattgtgtcaatgcttttctgcagaaaaatacttttttgccaaatcaaattcaggctattggttgccacgggcaaacggtatggcattctccaaattcacaatttccctttacaatgcaattaggcgatatgaatttacttgccgctaaaacaggcatttcggttattggggattttcgccgtaaggatatggcttggggtggacaaggtgcgcctcttgtgcctgcgtttcacgaggcggtattttcaaattctaattttgctacagctgttttaaatattggcgggattagtaatgtgtctattttgtttccaaatcaagctgtcatcggctttgatacaggtccaggtaatacattattagatcaatggatcgaaaaacatcaagggcttcgttatgatgaaaatggcgagtgggcagcaaaaggcaacgtgaataaagttctgcttgatgaattactcaatgaacctttcttttctttacctgcacccaagagtactgggagagaattatttaaccttgtttggttaaatcacaaaatagcaaaaataagggaaaaattgaccgcactttcagttgaaatgtcttttcgcccagaggatgtgcaagcgacgcttgttgaattgacggtaacaagcattgttaatgcactaaatcagctccaaacagatttaccaaaacgtttactagtatgtggcggtggtgccaagaatagcttaattatgcgtggattgcatgataatttactcgattggcaggtcagcacaacgacagagcaaggttttgatattgattatgtcgaagccgctgcttttgcttggttagcttattgtcgaatcaacaatttacctgcaaatctaccaagtgtaactggggcaaaaagtgcggttagtttgggggctatttttcctaaagactaaggtcaaaatatgaatgacattatattaaaaagtttatccacattaattacggaacaaagaaatccgaattcagttgatattgatcgtcaaagtacattagaaattgttcgattaatgaatgaagaagataaacttgtgccacttgcgattgaaagctgtttaccgcagatttcgttggcggtagagcaaattgtgcaggcttttcaacaaggcgggcgtttaatttatattggtgcaggcaccagtggtcgtcttggtgtattggatgcgtcagaatgccctccaacatttggcgtgtctacggaaatggttaaaggaataattgcaggtggtgagtgtgctattcgtcatcctgttgagggtgctgaagataatacgaaagcggtgcttaatgatttacaaagcatacatttttcaaaaaatgatgtattagttggtatcgctgcaagtggtcgcacaccttatgttattgcaggtcttcagtatgcaaaatcgcttggtgcattgacaatttctattgcgagtaatccaaaatctgagatggctgagatagccgatattgcgatagagactattgttggccctgaaatattgacgggttctagccgcttaaaatctggcacagcacaaaaaatggtgctgaatatgctgactacggcaagtatgattttattgggtaaatgttacgaaaatttgatggtcgatgtacaagccagtaatgaaaagcttaaagcccgtgcggtgcggattgtgatgcaagcgaccgattgcaataaaacattagcagaacagacattacttgaagcagatcaaaatgccaaactggcgattatgatgattttaagcactttatcaaaatcagaagcgaaagtattgttagaaagacatcaaggtaaattgagaaatgcgctttctaaataagacaaaaacctgattgtaaaatcaggtttttattttggaattccacgcaataatcctacaggctcaaaaggttctatagaagttggtgcaggcacttcgctgaataataaaataaatggcttgggcgggattactttttcattacgccataagttgcccattccgactaattgaatatcttcgggtaaattacgaagacctgcttgtaaaacagcaatcgtatttggacgaggatgacctattgcaatggcggagccgtgttttctagcatagtgaattgctgctttaaattgacgttgaacgtctgcgaattcgttactatcatctaaaaatatatggcgatctaatgaacgcacgccttgttcttttgctattttcccagctacagattttcctattgttcgactatctaaaaagaacaagtgtttttcttgaagtgcggtcattaaataagtcattaattggggatctgccgtagctgcactccccatatgattgttcataccgatggcatcacgcacaatatttttagccgtattaacgcgatcatttacttgtgccgcagacattcctaaatgcagcccaccgtcttctattttcactgcacttactggttgcatcggcatatggattaaaatatctctaccttgagattttgcttcttgattacgtgctcgagcatagggcgctgcaggaataattgctacggaaatttcacgtggcatcgcaaaaattgctgcatcttctttgagatgatagcctacatcatcaatcacaatagcaagtttactttgagcaaaagaaaaagaggtataaagtgcggtagaaaaaacaatgaaattttttaccgcactttttatcagaatattcatcaacgaacccaccctgcaggatttactggcgttcctttacggctaataccaaaataaagcgcagaacgtgatatttcccctgtatttcctacttgagcaataacctgccctgctgaaacaagctgaccaactttcactgatacagcttgattgaagccatataaacttaaatcagtttcgccgtgtttaacaataaccatataaccataaccatttaaatatcccgctaaaatgacgcgtccagcagcaattgctttaacaggcgtgcctgctgatgcgccaattaccatacctttccaacgtacttcgcctgcttggatagaaccaaaagtatgcaaaattgaaccagaaactggtaaggaatattgtttttttgccgcccctaaaccgcttgtactattaagtaattggcgttcttgcacagttggttgataaggttttgatgttcgtttttcttcagctttttggcgttgagcaagtgcctctctttcacgtttttcttgttcgcgcgctgcttgttcagctcgttgaatttcttgacgaagtgcttgttcgtttgcttttagtgtattcaatttatcttgatctagggctaaatttttattgagttcattcagcgtagattgatgctcttgctgtgctttttgcaatgcttgttgttgttttttttgtgtggaaagttgatttcggtgattcttttgttgagagagaatcgcctttttttgtactgcaatttgtgcttgcgttgcttttaaattattaatcatttcaatccgaacttgatttaaatgctgataataaactttcattcgctctgcttttgtcggatcttgggcaaacattcgttcaatcagcgatggattaatgcctgaacgataaattatatctatttgtttggttaatcgtgctttttgctcacgttcctgtttttctaattgtttgagttgcttatctgcatcggcaatttgcttacgaatttcctttaaacttatttctgtttcaagcagttcgccctcaacactgttaattttactctcgtgtttttttaaatttgcttgtaacttagcttgctcacgtttttgcttctctattttagattcttgttgcttaatttgtttttgaatttgattgagatcggaagattggctgacaggcgaaaatattaataaaccgcagcttaaaagtgcggttaataataatgatgttttttgattaacgccaaaacgcaacataattcatcctaaattcgtaaaactcgcaaatcttatcatatttgttaaaaggcgaaaaagtttgatggttattttttgctaaagatcaggaaatcatcccttttaacttttaaagctaaggattttttgctataaaatgtgcgttctttttatttgaaaaaattaggagattcttatggaattagtatttatccgtcacggttttagtgaatggaatgcgaaaaacttattcacaggctggcgtgatgtgaatttaactgaacgtggtgtggaagaagcaaaaactgcgggtaaaaaactgttagacaaaggttatgaatttgatatcgcatttacctctgttttaactcgagcaatcaaaacttgtaacatcgtgttagaagaatcccatcaattatggattccgcaagtaaaaaactggcgtttaaatgaacgtcattatggtgctttacaaggtttagataaaaaagcgactgcggagcaatacggtgacgaacaagttcatatttggcgtcgttcttacgacatttctccaccagatttagatccacaagatccaaattctgcacacaatgaccgtgcgctacgcaaatattccatctgatgttgtgccaaacgcagaaaatttaaaattaacattagaacgtgcattaccattctgggaagatcaaattgcaccagcaatgctttctggcaaacgtgttttagtggttgctcacggaaattcacttcgtgcgttggcaaaacatattatcggtatttctgatgctgaaattatggattttgaaattccaacaggccaacctttagtattaaaactagatgataaattaaattacgtagaacattactatctttaattaagttcaacgtattgttgttctaactgtataaaacaaaaccccgcaaattagcggggtttttaagcaagtccaaattattttgtgcttggaattttgaaacggctgttgaaacgctcgacacgaccaccagtatcaacaacacgttgtttaccagtatagaatgggtggcagttaccacacacatcaagattgatgtctttgcctaaagttgaacgtgttttgatcacattaccgcaagaacaagtcgcagtaatttctttatattctggatgaataccttgtttcatagaaaaacctcaaaatgaagccacgccgctataggaactttctccccacaccgcgtgagtgaataatacgccataattggcaccaaataggttgcgaattatactgaaaaaatgcagataaacaagctctattttcgtgtaaaatcatcagcatttttaaccgcacttttctttttatgttagcaaaatcttccatcaatgcgccatttgccaaatctgttttagcttggtacgacaagtttggacgcaagcatttaccttggcagcaaaataaaacgctttatggtgtatggctttctgaagtgatgttgcaacaaacgcaagttgcgacggtaattccttattttgagcggtttatcaaaacatttccaaatatcaccgcacttgccaatgcttcacaagatgaagtgttacatttatggacgggcttaggctattatgcacgagcgcgtaatttacataaagccgctcaaaaagtgcgggatgaatttaatggaaatttcccaacaaattttgagcaagtttgggcattatctggtgtgggacgttcaactgctggtgccattttatcttctgttttaaatcagccttatccaattttagatggtaatgtgaaacgtgtgttggcacgttattttgctgttgagggatggagtggcgagaaaaaagtagaaaatcgcttgtgggcattaacggagcaagttacacctacgacgcgtgtggcagattttaatcaagcaatgatggacattggtgcaatggtttgcatgcgaactaagcccaaatgcgatctttgtccgttaaatatagattgtttggcttataaaaatacaaactgggaaaaatttccagctaaaaaacctaaaaaagcgatgccagaaaaaactacctattttttaattttgtcgaaaaatggcaaagtatgtttggaacagcgagaaaactcaggattatggggcggattattttgttttccacaatttgaagataaatcctcgttgcttcattttttagcccaagaaaaagtcacgcattatcaagaatggccgagttttcgacatacattcagccattttcatttagatattcatccaatttacgccgaaatggagagtactttatgcgtagagcaggctaatttagactggcgaaaagtgatggaaagcacaaaagaataccaatcaaacctatcaagtgcggtcaaatattggtatgatccacaaaatcctgaaccgatcgggctggctcagcctgtgaaaaatcttttaatacaatttgtaaggaatcattatggcaagaacagtattttgtgaatatctcaaaaaagaagcggaaggcttagattttcaactttatcctggagagttgggcaagcgtatttttgattcagtaagtaaacaggcttggggcgaatggattaagaaacaaacgatgcttgtgaatgaaaaaaaacttaatatgatgaatgcagagcaccgtaaattattagaacaagaaatggttaattttttgtttgaaggtaaagatgttcatattgaaggttatgttccaccatcaaattagttatctatcctacaatgaaaaaatatttattattggcattattgccttttttgtatgcttgtagtaattcatcgaatcaaggtattaactatgatgaagcctttgctaaagacacgcaagggttagatattctcacagggcaattctcgcataatattgaccgtatttggggcgtcaatgaattgttagtggcaagccgtaaagattatgtgaaatatacagattctttttatacgcgtagccatgtgagttttgatgaaggtaatatcgttattgaaacccagcaagatttaaatcgattacataatgctattgttcataccttgttaatgggagcggatgcaaaaggtattgatttatttgcatctggtgatgtgccgattagctctcgcccattccttttggggcaggttgtagatcatcaagggcaacacattgctaatcaagttatcgcaagtaatttcgccacttatttgattcaaaataaattgcaaacacgtcgattacaaaacgggcataccgtgcaatttgtctctgttcctatgattgcaaaccacgtagaagtgcgtgcacgaaaatatttaccattgattcgtaaagctgcacaacgttatggcattgatgaaagtttgattttgggcattatgcaaacagaatcaagttttaacccatatgcgattagctacgcaaatgctattggtttaatgcaagtcgtgcctcatacagcaggtcgagatgtatttgcaatgaaaggcaaaggtggacagccatcaacgcgttatttatatgatcctgcgaataatattgatgctggtgtatcttatttgtggattttacaaaatcaatatttagatggaattacgaatccaacctcaaaacgttttgccatgatttctgcgtataatagtggtgcaggcgcagtgttacgtgtttttgataatgataaggatacggcgatttacaaaatcaaccaaatgtatccagaacaagtttatcgcattctaacgacggttcacccatcatcacaagcacgcaattatttgttgaaagtagataaagcacagaaaaaattccgtgttagacgataattgaattttttcagataatcaaaaatgctcgctggctaacaccattgagcattttttattaaaaaagtgcggtaaattttaaaatagtttttattatttcgttgttttaataaacatattgatgattaactattcaaatgaaatgttttttccattttttttgcatttagttattgaccgaaaaccgaaaaaatagtttaatacgccccgttgtcaggcagtagcctataacgataacgcctcgatagctcagtcggtagagcaggggattgaaaatccccgtgtcggtggttcgattccgcctcgaggcaccatttcctccttagttcagtcggtagaacggtggactgttaatccatatgtcgcaggttcgagtcccgcaggaggagccaaatttaaaaaagccgctaaagagatttagcggctttttgctttcttatatataaaatatataatcttctctagtcttgtaactataactaggcatcaaaattcaaaatggcgtatcaatgagcgagagccttcttatttttgatgttagcaagcgaccttagtcgcttgcgtttaacttaaagaagaaaaatgagtcgacttttattttggaatagatttatttttcacgatcatcgatggtttgcagcaaataatttccctctgcatcagcaagactgcggaaacctacattcgtgattttgtagggatactttgttcgataagtaaagttttcgtgatgatgtccgtggaatactagcttaacccccatcttcattgccaaatcattaattacttggaaacccatcggatgtggtttaggggcttcgtgacaaatcaacacatctgcttgttggttttctaagatttcaatatctgatggaaaaattgacgtgcgatgacgcaaaggcacaccgcctcgccaaatcttctcctgtgggctatattggcaataatgaataggatcaaaaaacatggggcgatttggtggcatccaaatttgcccgcggaatacaccgcctaatcccgcaatgcgagttccttgaatatcaactacgcgattgtgtaaattgcgtgattgccactcagagccccaaattgaatcaaaagcactaatggttttgctatcatgattaccatgaataaaccaaatatcacaatgtttcgcaagtttatccaactcatctgatgtcgtgagctgtaaatcgcctaaaattatcagtgcgacattttcctgttcttttataaaagggtaaatgtgatcatagcttccgtgcggatcaccagcaaataaaatcattgagatgtcccttttataggaaaggttgtgttttgtaattcactgatttcctcttcatttaacactttctcaatgactgctttaacttggttatagcgatcaagataacttggtgattcaatctctatataaggaactttatatttatctaacagttttttgagtagttgttgaaattgttggcgttgtttttgtgagcctaagctacgcaagccatcatccacccattcagtattgtttttaagtaaaatagtgacatcgaagggatattctttaatcattgagtctaaaaatggatgggcttttccttcatattgaatgcagaatgcttgcgtggtgatgaaatccgtatcaataaatgcaattttatgagaatggcgcacggcataatcaatgtatcgttgatgaccaagcgccatttgcggatagtcagaatattgcatcgcttgctcgtcgccaccgagcttttcaaatacaaattcacgcccgtattcccacgcagaagtggtattaaatacggcggctaacttattaactagcacgcttttaccactgctttctccccctaaaatcgccaccgttttggcaaagaaaggacgagcttctttcggaataaacttccaatattggaatggagtggtgcgaattttggtggcggacacattaaagaaagtgcggtcaggatcgactaacgaaacttctaaacctaagtatttctcgtaaggcgctttatcttgaggttcgctactaaatacgattgaaggctcaaaatgtttttcatgaaatagggttttaactgcttcactccaagattgccagccgtttggataactcggaataccgtcttcaaccaaatgatgaataaaaatctgatttttttgatatttgaaaatttgctgcatccaacgcaaacgatcttgcacggttggcatgcgtttcattttactatcgtaaaataatttcaaatcgcgcacagtgtcactacacacgataacgtgtagttcatcgactttactgaacgcttcataaatcatatttatatgacctgtgtgtacaggataaaatttcccgaaaatgacaccgacttttttctcttttgtttttgacataatctgctcttgatagcgtaagaattgagtgtgtttattgtaggctaaatgaaaatatttttcacgttctgatttagtgcctaggtattttgcgttatacttagctcgcattctcagggcagggtgaaattccctaccggtggtaaagcccacgagcgtttaaaagtgcggtcaatttttggcaaatttttcctgcgaaattgtcctgattttcacttttaaagtcagcagatttggtgaaattccaaagccgacagtaaagtctggatgaaagagaataaaacgagttgggttcccaaatcgtttattttatttgcatttctcagccctgattctggtatttaattgaaatctcaaattaggaaattactatgaatcagtcaattttatctccattcggcaacaccgctgaagaacgcgtacttaatgcaattaatgcctttaaaaatggaactggcgtattagttttagatgatgaagatcgtgaaaatgaaggcgatttaattttcccagcagaaacaatcacgccagaacaaatggcaaaattaattcgttatggcagtggcattgtttgtttatgcattactgatgaacgttgccaacaactcgatttaccgccaatggtagaacacaataatagcgtaaacaaaacggcttttactgtaacgattgaagccgcaaaaggtgtttctacaggcgtatctgccgcagaccgagtaacaaccattcaaacggcgattgcggataatgctgttctgacagatttacatcgtcctggtcatgttttcncacttcgtgcagcaaatggtggcgtacttactcgccgcggacacactgaagcttccgttgatttagcacgtctggcaggatttaaagaagcaggcgttatttgtgaaattactaacgatgatggcacaatggctcgcgcccctgagattgtagaatttgcgaaaaaatttggttattccgtgctaaccattgaagatttagttgaatatcgtttagcacataatatttaaaatgcaaaagtgcggtgaaaatttctatgatttttttaccgcactttttatattatactgttccaactttttatttatttgggttacttattatgcataatgcagctcagcacaattatgttatcagtttaactactgaacaaaaacgccgaaaacatattaccgaagaattcggtaagcagaatattcctttcgaattttttgatgctattacgcccgacattattgaagaaaccgctaaaaaatttaatattacattagatcgctctcctaaagccaagttgtcggatggggaaattggttgtgcattaagccatattgttttatgggatttagcattagaaaataatttaaactatatcaatatctttgaagatgatattcatttgggggaaaatgccaaagaattattagaaattgattatatttctgatgatattcatgttttaaaattagaagcaaatggcaagatgttctttaaacaaccaaaatctgtaaaatgcgatagaaatgtttatcccatgacggtaaagcaatcaggatgtgcaggatatactgttacagcaaaaggggctaaatatttgcttgaattagtaaaaaataaaccacttgacgtggcggttgattcacttgtttttgaggattttttacattttaaagattataaaatagtacaactttctcctggtatttgcgttcaagattttgtgttacatccagataatccttttgaaagcagtttacaagaaggacgagatagagtacacggaaatcaacgcaagtcctctattttagaaaaaataaaaaatgaatttggacgagtaaaaataaaaatgtttggaaaacaagttccatttaaataataaaagtgcggttaaaaatcttattaaattttaaccgcacttttttgtttattttacttctggtaaatttaccgcacctttatagcctaattgtcgccacgcttcataaaccgttactgcaacagaattagacaagttcatactgcggctattggcagtcattggaatgcggattttttgttccatcggcatttcatttaaaattgacatcggaatgccacgagtttctgggccaaacattaaataatccccaagtttaaatttcacttggctatgtgctggacagccttttgttgtaagtgcaaaaaggcgtttgggtttttcgctttctaaaaaggcttcaaaggttttgtggcgtttgatttccgcaaattcgtgataatccaaacctgagcggcgtaagcgtttatcatcccaagtgaaacctagtggttcaattaagtgcaagcgaaatcctgtgttggcacaaagtcgaataatgttaccagtattttgtgggatttctggttcatataaaacgatatctaacataattttctctctaattctgatataaacgatagctcactattcccgtcgttttttctttcaataacgtccagttttcaggagtgatgagcggtttatctttctctgtttctacgtaaattaacgcattgggttttagccagttattttcacaaagcaaactaattgcttgttctgccaaattaaaatgaaatggaggatctaaaaataccacatcaaagtgcggttgattttgtggctgttttagaaaatccaaactactttgattaattacttcagcctgttctgatgagcatttgagtgtttgtaaattcttttttaattgattggcgacagttttatctagttctaaaaaagtcacttttttcgcttggcgagaaagtgcttcaaaacctaatgaaccactccccgcaaagccatctaaacattcagattggtggatataaggcattaaccaattaaaaagcgtttctttcactctatcgccagttgggcgtaagccttcagaatttaatacgggaagttttcgccctcgccatagacctgcaataatgcgaacctcgccctttgcatttggcgtttgtatttttttcataaagattcgatttttattgaaaattgtgcttagtttagacgattttttgctagaatgaacgacatttttatcggattacagttaagagagcattttatggctgaagaaaataaaaaaggcggattttgggcatcgttatttgggcgtaataaaaagcaagatgaacctaaaattgagccgataattgaagaagaaaagataaaagatatcgagccgtctattgaaaaatttgaagctaatgatttagtcgaagaagaaaaaatacaggaaatttcaaccgcacttgagccgattgaagaaatcatcgaagcgaaaaatttagaagatgagtttcagcctgttgttgaaattgaaactcgcgaaaaaccaagtgaagggggcttttttagtcgtttagttaagggattactgaaaactaaacaaaatattggcgcgggttttcgtggttttttcttaggaaagaaaattgatgatgagttgtttgaagaattagaagaacaacttttaattgcggatattggtgtgccgacaacaagtaaaatcatcaaaaatttgactgaacacgcaagccgcaaagaattacaagatgccgagcttttatatcaacaattaaaagtagaaatggcggatattcttgagccagtagcacaaccgttagagattgatagcacgaaaaaaccttatgtgattttaatggtgggcgtaaatggcgtgggtaaaacaacgacaattggtaagctcgcacgtaaatttcaggctgaaggaaaatcagtgatgcttgcagcgggcgatactttccgagcggcggctgttgagcagcttcaagtttggggagaacgcaatcatattccagttgttgcgcaaagcacgggttctgattctgcgtctgtgatttttgatgcgatgcaatcagcggctgcacgcaatattgatattcttattgcggatacggcgggtcgtttacaaaataaaaataacttaatggacgaactgaaaaaaattgttcgtgttatgaaaaaatatgatgaaactgcgccacatgaaattatgcttacgctggatgctggcacgggacaaaatgctattagccaagcgaagttatttaatgaggctgtgggtttaacaggaatctctctaactaaattagatggcacggcaaaaggcggcgtgatttttgccatagccgatcagtttaagttgcctattcgctatatcggtgtaggcgagaaaattgaagatttacgtgagtttaatgcgaaagaatttattgaggcattattcgttcatgaagaagaataaaaagaataaggaagaattgtgattaagttctcaaatgtttctaaagcctatcatggcgcaacacagcccgccttacaaggcttgaattttcatcttcctgtgggaagtatgacttacttagttgggcattcaggcgcagggaaaagtacattactcaagcttattatgggaatggaaaaagccaatgcgggtcaaatttggtttaacgggcatgatattactcgcttgtcgaaatatgaaattccatttctgcgtcgccaaattggtatggttcaccaagattatcgtttattaacagatcgtactgtagtggaaaatgtggcattgccgttgattattgcaggtatgcatccaaaagatgcgaatactcgagcaatggcatctttagatcgtgtaggattgcgtaataaagcccactatttgccaccgcaaatttctggcggagaacagcaacgcgttgatattgcgcgtgcgattgtgcataaacctcaactcttattggcagatgaaccaacgggtaatttagacgatgaactttctttagggatttttaatttgtttgaagaatttaatcgtctcggaatgactgtgttaattgctactcacgacattaatttaattcaacaaaaaccaaaaccttgtcttgtgcttgaacaaggttatttacgttattaaggaataatcatgagccgatcaacggatgcatctgtttttgttcaaacagcctatactttgcgtgcagtatgggcggatttgtggcaacgtaaatttggcacgctgctcacgattttagtgattgccgtttcgcttacgatcccgactgtgagctatttaatgtggaaaaatttgcatttagccaccactcaattttatcctgaaagtgaattgactatttatcttcataaaaatttaagtgaggaaaacgcaaatttagtggtagagaaaatccgtcagcaaaaaggcgtggaatcactgaattatgtctctcgtcaagaaagtttaaaagaattcaaaagttggtctggctttggtgaagaattggaaattttagatgataatccattgcctgcggtcgttatagtaaaaccgacgagcgaatttaatgtttcagaaaaacgtgacgaattacgaaccaatttaaataaaattaaaggcgtgcaagaagttcgcttagataacgattggatggaaaaattgaccgcactttcttggttaatcgcccatgtggcaattttctgcactgtattaatgacgatagcggtatttttagttattggtaacagtattcgctctgatgtgtatagtagccgatcaagtattgatgtgatgaaattgcttggtgcaacagatcaatttatccttcgtccttatctttatacagggatgatttatgccctgttaggtgggttagttgcagcaatttttagtagctttattatcagctattttacttctgcggtgaaatatgtaacggatatttttgccgtccaattcagtttgaatggattaggcgttggcgaatttgtattcttattagtgtgctgtttaattatgggctatgttggggcgtggattgccgcgacaaggcatattgcgatgatggagaggaaagaataattggatatcaaaagaaaagcgaatttcttaaaagaaattcgcttttttagttagaagtgaaatatttcgctgttgtagtttaggaagtaaatagttataagcgttctacaatcatagaaatcccttgaccaccgccaatacaaagtgtagcaagtccaagttttttatctttttcgataagattgtgcaataacgttactaaaatccttgcaccactcgcgccgattggatgcccaagtgcgatcgctccaccatgaatattggttttattcatatccaaattgagatctttgccaacacctaagaactgtgaggcaaaggcttcatttgcttctatcagatcgatatcatcaagatttattcctgcttttttcaatgctttttgcgttgctggaactggacctaatcccataacagatggatctaccccaccgctggcatagcttctaatttttgcaatggcttttaatccaagtgcatgagctttgctttcgctaactaaaataagtgctgcagcaccatcattaatgccagaagcgttacctgcggtgacagtaccctcttttttgaaagcaggttttaatttagctaaaccttcagctgtagtatctgctttaggatactcgtctcgtgaaacaataatgtcacctttgcgagtttttaccataacagggacaatttccttatcaaatacacctaattgcacggcttgagatgctaaggtttgtgaacgtaatgcgagttcatcttgtgcttggcggctaataccatattgttctgcaatattttcggcagtaatccccatatgatagtgattgctagcgcaagttagtccgtcttcaatcattgtgtcccttaatgtgagattacccattttgacgccttgtcgtactttgctatctaaaagataaggtgcttggctcatattttccatgccacccacaacaacaatatcagcatcaccactgataatagactgtgcacctaatgcgacactttttagaccagatccacatactttattgattgttaaagaagggatttctttctctattcctgcttttaatgctgcttgacgggctggattttgccctagtcctgcttgtaatacgttccccatgatgacttcattaactaatgcactttcaatgttggcacgtttgatggcttcttgtatcacaattgcacctaaatcaaccgcacttacggaagataatgcaccattaaagctgccgatcggtgttctaactgcactaacaataacaacattttccatttttaactccttttctataagaaatataaaccaataataaaaattggtgcggtgaagataagtgcggtcatacagaagcccataatatctctcacgccaagccctgcgatacccagtgctggtaatgcccaaaatggctgagccatgttcatccattgctcaccataggcaatcgccattgtagacttacctagatctgcacctaatgcttgagcagcagggataacaaatggtccttggatgacccagtgaccgccaccagaaggaactgcaaagttaataaaggcagaactaaagaaggttaataatgggaaagaatctttgttagcaacattgataaagaattcggtgattaaaccacctaagcctgaatgctccatcattagttgcacacccgcatagaatgggaattgcactaagatccctgctgtgcttcgtgtggcattaataattgctcgcatataggccattggcgagccatgaagcacaattcctgtgattaagaaaataaggtttacattattaattgtgagattgaatccgtttttgtagaaatacataccgaggtaactatatcctaatgccccgattgtataggctaagaagcggctttcttccattttttcagcaagtgttgcatctttatccaattttttatcaaatgttggatcgggcgcaataagttttggatcaatactttttgtttcgccatttttgggcatcatcatataggtaatgaaaggcaagcaaatgactaaacttaacgtgataaaaatattgtacccagagaaaagcgtactaactgcaggaataataccttgtgggttgctttcgctcatcattaaatgagcaactgggttgcctggtgttgcggctaaaagtggcattgagcctgaaaaacctccaccccatgtcataaatgcaatataggcacaggcaatcagtaaggcgtagtcactgccttttattctccgcgcgacttcttttgcaaacatcgcaccaacgaccaaaccgaagccccagttaatgatacaggcaattgaacccataaacgtaactaagacaacaccttgtgctggtgtttttgcgattgaagcgattgtagaaagaaacttacgaatttgtggtgaggttgcaagagcattaccagttacgacaattaatgccatttgcataccaaaaccaagtaaattccaaaagccattaccccacatattaactaaatcaacaggtgtactatcggttaatccccaagcacaaatgaatgtgacaaaggtgagtaacacggcaaaaataagtgggtctggcaggtatttactgacgaatgtcgtcataaaacgagaaacgcgactaatcataattcaagtcctttctggctgatttgcatttctttgaaatcatcggcaacaatgaaatcggcttctgttttggctttaattgtttctaaatccacatgaggagcatgttcttttagaactaatctgccttcaatgaagttaaatactgccaattcggtaaccaccatggcaacttttttacttgctgtgagcggtaatgtacatttctttagaatttttgaggaacctgacttggcacaatgttccatgccaataatcactttttttgcaccagtcactaagtccattgctccgcccattcctggtaccattttgccaggcaccatccagttagcgagatttgcttcttgatcaacttcaagtccacctagcacacaggcatcaacatgaccgccacgaattaaagcgaaagaaaaagcactatcaaaagtagagccgccttttttaattccacaaggctgaccaccagcatttactaagtttgaattagcattttctgggtcaaatgcagttaaaccaagaaagccattttctgattgaagtgtaatattgacattatcaggtaaataattaacaacctgtgttggtaaaccaataccgagattaacaatatctccatcatgtaattccatcgcaattcggcgagcgattaattcttttgcattcatggcgttctccttattctgaacaaacaatgtaatcaattaatgcggctggcgtgatgacttcatctgggggtaactgaccgacctctagtagattatcaacttgggcaatgacagttttggctgctaaagcaactagtggattaaagttcctagcagataattcataagctaaattgccattcatgtcacctttttgagcatggataatggcaatatcagcttttagtgggagttcaagcaaatattctctgccatcaatttgaattttttgttttccttcttcaacaacagtgccgacacccgttggtgttaaaataccacctaatccggcgccacctgcacgaatccgttcagctaaggttccctgtggaacgagttctacatctatttcaccagcaatcatttttttgccagtttctggatttgtaccaatatgggaggtaattaaacgtttgactcgattatttacaattaaagggcctacgccagtgtcaataaaggctgtgtcattgcctatgagtgtgagatcctttacgccagaatctaagatttgttggacaagtttggctggagtgccgatacccataaatccaccaaacatgatgctcataccatcatgtaggtgttgatttagattattaagcttaagatgtttttgtgtcatagagacctcctaataacgagattaaaagaaagaatatcaacaaataagtatcttatatttcaaatggatatgtttcttgcgatgatccttgataggcaataaaggaactagattgatattaaaaatagcaaaaagaatttcgtaaaagaaatacatctttcttaggcgggtataagttattttgatagtgttttaaacaatccttgtgctatattttgtaaaaatggcagtccttaggggggtgaaaatgatggatattaggcatctaagatattttgtttcaatcgtagataatgattttaatttaagccgagcgtctcaaaatttatatgtgtctcaacctgcattaagtatgatgattacggagtttgagaatcgtgaaaatattcagatatttaaacgggcatcaggaaaaattattggactaacctttgcgggggaaaattattatcgtgatgcaaaagaagtgatcaagcgttacaatgatatgagaacaaatctttataaatcaaaagattgtaagaaaggcacgataacaattggtattcctcccttagttttatcagccgtgttctcttctgtattgcctcatcttattcttaagaatccagatattaatttcattattaaagaaattggagcttatgctctaaagagtgaacttcttttagataaagttgatttagccgtgttgttatatcccgagcgaatatcaaaaaatattattgattcaattgaaattcatagttctgaattagccttatttctttcaccaaagcatgttttagcaaaaaaacaacaaatcacatgggctgatttacatcagcagaaaatggcaatttttgatcaaacatttatgattcatcatcatttgaaggaagcttttgagcgcaataattgttatccagatattgttttggattcgagttgttgggattttctgctaagtgcggtcaaaacaaacaaagaattattaactattctaccgttacctatggctgagctttatcattcaaaagaatttttgtgtcgtaaaatcgaaagtcctgttccgtggaaagtgacactatgtcgtcaaagaaaaacggtctacacacatcttgaagaatatatttttgataaattattagaggcttttagaccaacaaaatagttaaaataaaagcttgcaaatagggttgtctttctatagaatctacgagctctcaatatgagagccgtttaatgtaatcatttattgaacgggcatgacgatatgtcaggctaacaatgtttccgatttggagactatataacaggtaacttgcacctccttttctattttgaagttagaattgcgattggtgttagtttttttattagctaaattttattggagctctggtctaatgcagaaccaaagaatccgtatccgcttaaaagctttcgatcaccgtttgatcgatcaatctactgcggagatcgtagaaacagctaaacgtactggcgcacaagttcgtggtccaattcctttaccaactcgtaaagagcgtttcaccgtgttgatttctccacacgtaaacaaagacgcacgtgaccaatacgaaattcgtactcacaaacgtttagtagatatcgtagagccaacagaaaaaactgttgatgcattaatgcgtttagatttggctgccggcgtggacgtgcagatcagcctaggttaattaagaggttattacaatgattggtttagtcggtcgtaaagttggtatgacccgtatcttcaatgaagacggcgtgtcagtaccagttaccgttatcgaaattgaagccaaccgcgtaactcaagttaaaactcttgaaaacgatggctatactgcagttcaagttactactggttctaaaaaagcgaatcgtgtaactaaacctgaagcaggtcatttcgtgaaagcaggtgttgaagctggtcgcggtttatgggaatttcgtactgaaggtgaagaattcactttaggtcaagaaatcaatgtagacatctttgcagatgttaaaaaagtagatgttactggtacttctaaaggtaaaggtttccaaggtggtgttaaacgttggaacttccgtactcaagatgctacacacggtaactctttatcacatcgtgtacttggttctattggtcaaaaccaaacaccaggtcgtgtgtttaaaggtaaaaaaatggcaggacatttaggtgctgaacgtgtaactgttcaatcacttgaagttgttcgtgtagatgctgagcgtaaattgctattagtaaaaggttctgtacctggtgctatcaatggcgatgttatcgttaagccggcagttaaagcataagtctaggagatagagatggaattacaagttgtaggtgcaaacgcactcactgtttctgaaactaccttcggacgtgagtttaacgaagcgttgatccaccaagttgttgttgcttatgcagcaggtgcgcgtcaaggtactcgtgcacaaaaaactcgtgctgaagtgtctggttcaggtaaaaaaccttggcgtcaaaaaggtacaggtcgtgctcgtgctggtgatatcaaatcaccaatctggcgttctggtggtacaaccttcgcggctaaaccacaagatcacagccaaaaagtgaacaagaaaatgtaccgtggtgctatcaaaagcattctttctgaattagttcgtcaagaccgtttggttgtggtggaaaaatttgaattagatgcaccaaagactaaagttttagtacaaaaattaaaagatttagccgttgaagatgcgttaattatcacagcaagtttagatgaaaatctattcttagcagcacgtaacttatataaagttgatgtccgtgatgttcaaggtatcgatccagttagcttgatcgctttcgataaggtgattgttactgttgatgctgtgaaacaaattgaggagatcctagcatgagtcaagaacgtttgctaagtgtgctacgtgcaccgcacatctctgaaaaagcaactaacaatgctgaaaaatctaacactgttgtacttaaagttgctttagatgcgaacaaagctgaaattgctgctgcggttgctcaattatttgaagtaaaagtagattcagttcgtactgtggttgttaaaggtaaaactaaacgccgtggtaacaaaatgggtcgtcgcagcgactggaaaaaagcttatgtaactttagccgaaggccaaaacttggacttcgtggacagtgcagagtaatcggaggaaattagagaatggctatcgttaaatgtaagccgacctccgctggtcgtcgtcacgttgttaaaatcgtgaaccctgaattacacaagggtaaaccttacgcacctcttctagatactaaatctaaaactggtggtcgtaacaactatggtcgtattactactcgtcacattggtggcggtcacaaacaacactaccgtttaatagatttcaaacgtaacaagttagacattccagcggttgttgagcgtttagaatatgatccaaaccgttctgctaacattgctttagtgctttataaagacggtgaacgccgttatattttagcacctaaaggtttgtcagtaggcgatcaaatccaagctggcataaactcaccaattaaagtgggtaactcattaccaatgcgtaatatcccagttggttcaacagtacataacgttgaattaaaaccaggtaaaggcggtcaaatcgctcgttctgctggtgcttatgtacaaatcatcgcacgtgaaggcaactatgtaactttacgtttacgttctggtgaaatgcgtaaagtattagctgaatgtgttgctacaatcggtgaagttggtaactcagaacatatgcttcgcgtattgggtaaagctggtgctaaccgctggagaggtattcgccctacagttcgtggtactgcaatgaacccagtagatcacccacacggtggtggtgaaggtcgtaactttggtaaacacccagtaactccttggggcgttcaaactaaaggtaagaaaactcgtcacaacaaacgtactgataaatatatcgtacgtcgtcgtggcaaataatagattaaattaaagaggattagccatgccacgttctctcaagaagggtcctttccttgacctacacttgttgaagaaggtagagaaggcggtggaaagcggggataaaaaaccaattaaaacttggtcccgtcgttcaatgatcattccatcaatgatcggattgaccatcgcagtccataatggtcgtcagcacgttcctgtttatgtatctgatgaaatgatcggtcataagcttggtgaatttgcaccgactcgtacataccgcggtcacgcggcagataagaaagctaagaaataagaggtaaagagatggaaactatcgcaaaacatcgttacgctcgcacttctgcccaaaaagctcgcttagttgccgatttaattcgtggtaaaaaagttgcgcaagcattagaaattttaactttcactaacaaaaaagcagcagctttagtgaagaaagttttagaatcagctattgcaaatgcagagcacaatgacggtgcagatattgatgatcttaaagttgctaaaatcttcgttgatgaaggtcctagcatgaaacgtgttatgccacgtgctaaaggtcgtgcagatcgtattttaaaacgtactagccacattactgtggttgtgtcagatcgttaataagtagaggaatagcaatgggtcaaaaagtacatccacatggtattcgcctaggtattgttaaaccttggagctctacttggttcgcgaatacacaagacttcgctgacaatcttgaaggcgatttcaaagtacgcaaattcttaaataaagaattagcaagtgcttcagtttcacgtattactattgagcgtccagctaaaagtattcgtgtaactattcacacagctcgtcctggtatcgtaatcggtaaaaaaggcgaagatgttgaaaaattacgtaacgcagtgtctaaaatcgctggcgttcctgctcaaatcaacattgctgaagtgaaaaaacctgaattagatgcgaaattagttgcagatagcatcgcttctcaattagaacgtcgtgtaatgttccgtcgtgcaatgaaacgtgcggtacaaagtgctatgcgtttaggtgctaaaggtatcaaagttgaggttagcggtcgtttaggtggtgcagaaatcgcacgttcagaatggtatcgtgaaggtcgcgtacctctacatactcttcgtgcggacatcgattataacactgcagaagctcacacaacttacggcgtaatcggcgttaaagtgtggatcttcaaaggtgaaattcttggtggaatggctgccgttgcgcaatcagaacaacaacctgccgacaagcctaaaaaggctcctcgcggtaaaggtcgtaagtaaggagaaacgctaaatgttgcaaccaaaacgtacaaaattccgtaaagttcacaaaggccgcaaccgtggtatcgcgagcggtactgaagttagtttcggtacttacggtttaaaagcagttggtcgttgtcgtttaaccgctcgtcaaatcgaagcggcacgtcgtgcaatgtcacgtgcagtaaaacgtcaaggtaaaatctggattcgtgtattcccagataaaccaattactgaaaaaccattagaagtccgtatgggtaaaggtaaaggtaacgttgagtactgggtagccttaatccaaccgggtaaagtgctttatgaaatggatggtgtgtctgaagaagtagcaagaaacgcatttgcattagcagctgctaaattgccagttaagaccactttcgtaactaagacggtgatgtaatgaaagctcaagatttacgtacaaaaagtgttgaagagctgaatgctgaattagtaaaccttttaggtgaacaattcaagttgcgtatgcagacagccaccggtcagcttcaacaaacccatcaggctaagcaagtgcgtcgtgatattgcacgtgtaaaaactgtattaaccgaaaaggcgggtgagtaatgactgataaaattcgtagcgtacaaggtaaagttgttagcgacaaaatggaaaaatctttcgttgttgctattgaacgtaaggtaaaacaccctttatatggtaaatttatccgtcgtacaactaaattacacgtacacgatgagaacaatgaagccaaagttggtgataccgtagagattcgcgaatgtcgccctctatcaaaaaccaaatcttggactttagttcgtgttgttgagaaagcagttattgcttaattaataacaaagagtaataaaataaaagccaatagtgtaaatctattggcttttttgtttttaaagtgcggttaaaattcaatgaattttaacccgcaccttttcttttaggtgttattgacataacacctaaacaaatactgaaaaaaatatttttaataatggtacttaagagaaatttctgaagatcttggttttgaatattctgatgagtggaatactcgttatttgggtcatagattaattaatttcatcaacggcgttgatacccgtaaagaaacgtcaaaattagcagaggataaattcccagaagaacttatcaatgatacagatactactgggaatatttctaatgaagattgggattggtggtgccatttatctgatacaatgaagtatatattgatacatgatcttccttatcaagaagaggagattggcatcacagagttttatgatgaaaatgatttggatacagaagcagatatatatgatcgagagacttttggaatcttattaggagaatatgtaacaggattatatttgttagatgatacttttatagagccagtgcttgataatataaatattcctaacaatgtttatagtacaaatatatttgctattcattatgttgcaaagcatattttgggtattaaagatctagataaacgtttaaaatctggtgatattgaattagttcgtgaattaggagaagtaacaattggtggtaaggagaagtatttttactcttttgcaactaaatattgtagtcatcataatccaattgctttcccaatttatgatagctatgtggagcaagttctcctctattttaataaagtagataaattttcagcctttaaaaggaaagatttaaaaaattacagaaaatttaaagaggttttgatagattttcaaagatttaacttaaaagaactcgatctgtatctttggcttttaggcaaggaaattttcccaaaatctaaaaactgatgaatttatctaaggtaagagaagagagcatttcattttttctgcagtttatttttcattcgataaatttttgagaggatgaggatatttttataattccaaaagtgcggtaaattttaactggattatttagtaaatagatcaataagaggaagctaaattatcattgcctttctctttttcttttgataaaatccgccgcctatctgccattctatctgaatagtgtggatgggttcgtcccgaaagggtgtttttttaatcttaacggagcactaatatgatccaagaacagactatgctggatgttgctgataattcaggcgctcgcagcgtaatgtgtatcaaggttctaggtggatcgcaccgtcgttatgctgcgattggcgacatcatcaaaattactgtaaaagaagcaattccacgcggtaaagtaaaaaaaggtgatgtattaaaagcagttgttgtgcgcaccaagaagggtgttcgtcgcccagatggctcagttattcgtttcgatggtaacgcttgtgtaattttaaataataacactgagcaaccaatcggtactcgtatttttggaccagtgactcgtgaacttcgttctgagaaattcatgaagatcatttctttagctccagaagtactgtaaggggaatgtaatgcctgctaaaatccgtcaaaatgatgaagtaattgtccttactggtaaagataagggcaagcgtggcaaggtaactaaagtgttaccaaacggtaaagtgtttgttgaaggtatcaacatcattactaaacatgaaaaaccagttcctgcattaggaaaggctggtggtttggtgaaaaaagaagctgcaattgacgcttcaaatgttgcgattttcaatcctaaaacaaataaagctgaccgtgtaggttttagattcgaagacggcaaaaaagtacgtttcttcaaatctaacaatgaaattatctaacaaactggagtaatgcgatggcgaaactgcatgattactacagagatcaagtagtaagcgaattaaaaaataaattcggctacaaatctgtcatgcaagtcccacgaatcgaaaagattaccctgaatatgggtgtgggtgaagcattgaccgacaaaaaattgctagacaacgcagtagcggacttagcagcaatcagcggtcaaaaacctttagtaactaaagctcgtaaatctgttgctggctttaaaatccgtcagggatatccaatcggttgtaaagtaacactacgcggtgagcgtatgtgggagttctttgaacgtttaattacaattgctgttccacgtattcgtgacttccgcggtttaagtgcgaaatcattcgatggtcgtggtaactatagcatgggtgtgcgtgaacaaatcatcttccctgaaattgattacgataaagtagatcgtgtacgtggtttagatatcactatcacaactactgctaagaatgatgaagaaggtcaagcactacttgctgcctttaatttcccattccgtaaataaggcaggttataatggctaaacaatcaatgaaagcacgcgatgtaaaacgcgttaaattggctgaaaaattctacgcaaaacgtgttgaattaaagaaaatcatttctgatgtcaatgcctctgatgaagatcgttgggatgcagtgttaaagttacaaactttaccacgtgattctagcccatctcgtcaacgtaaccgttgccgccaaactggacgtcctcatggcgttttacgtaagtttggtttaagccgaattaaggttcgtgaagctgcaatgcgcggtgaaatcccaggccttaaaaaagcgagctggtaatataccactttattttggaatcggagaaaaagtacaatgagtatgcaagatccaatcgcagatatgctgacccgtattcgtaacggtcaagctgcgaacaaagttgcaatcaatatgccttcttccaagctaaaagtggcaattgccaacgtattagctgctgaaggttatatcgaaagcgtaaaagttttagaaggtgctaaacctgaattggaaattactttaaaatatttccaaggcaaaccagttgtagaaagcatccaacgtgtaagtcgtcctggtcttcgtatttacaaacgtaaagatgaattaccaaaagttatgggcggtttaggtgttgcagttatttctacatctaaaggtgttatgactgaccgcgctgctcgtcaagcaggtttaggcggtgagatcatctgttatgtagcttaatagagaggtaggaaaatgtctcgtgttgcaaaggcacctgttaatattcctgccggcgttgaagttaaactcgacggtcagctattaacagtaaaaggtaaaaatggcgagttatctcgcaaaattcatgaatcagttgaagtaaaacaagataacggacaatttacgttcactccacgtgaaggttttgttgaagcaaatgctcaatcgggtactgcacgtgcattagttaatgcaatggttatcggtgttactgaaggtttcactaaaaaattagtattggtgggtgtaggttacagagctcaacttaaaggtaacgcaattgcattaagtttaggctattctcacccagtagagcacactttgccggtaggtattactgcagaatgtccatctcaaaccgaaatcgtgttgaaaggtgcagacaaacagttgatcggtcaagttgcagcagatattcgtgcttatcgccgtcctgaaccttataaaggtaaaggggtacgttacgctgatgaagtggtacgtatcaaagaggctaagaagaaataattaaggtaacactatggataagaaatcagctcgtatccgtcgtgcagctcgtgcacgtcatatgatgagagagcaaggtgtaactcgtttagttattcaccgcactccacgtcatatttatgcacaagttattgcaccaaacggttcagaagtgcttgccgctgcttcaactgttgagaaagcaattcgtgagcaagtaaaatacaccggtaataaagatgctgctgcagcagtaggtaaagctgttgcagaacgcgcattagcaaaaggcgttcaagctgttgcttttgatcgttccggttttaaatatcatggacgtgtccaaactttagcggacgctgcacgtgaagctggtctacagttctaatgaggtaaattgagatgtcaaacatcgaaaaacaagttggtgaactgcaagagaagctaatcgcagtaaaccgtgtatcaaaaactgtaaaaggtggtcgtattatgagtttcactgcattaacagtggtgggcgatggtaatggccgagtaggttttggttatggtaaagctcgcgaagttccagcagcgatccaaaaagcgatggaaaaagcacgtcgcaatatgattaatgtcgctttaaatgaaggtacattacaacatccagttaaaggtgttcatactggttcacgtgtatttatgcagccagcaagtgaaggtacaggtatcatcgctggtggtgcaatgcgtgcggtattggaagttgcaggtgtacgtaacgttctttctaaagcgtatggttctaccaacccaattaacgttgttcgtgcaactattgatgcattagcaaatatgaaatcaccagaaatggttgctgcaaaacgcggtaaaactgttgatgaaatcttggggtaatgaataatggctaaaactattaaagtaacacaagttcgtagctcaattgctcgtttaccgaagcataaagctaccttgcgtggtcttggtcttcgccatatacaccacactgttgagttaattgatacgcctgcagtacgtggtatgattaaccaagtttcatacatggttaaagtggaggagtaagagatgcgtttaaatactctatctccggctgaaggtgcaaagcatagtgctaaacgcctcggtcgtggtattggttcaggtttaggcaagactggtggccgcggtcataaaggtcaaaaatctcgtactggtggcggtgttcgtcgcggtttcgaaggtggtcaaatgccgttataccgtcgtttaccaaaatttggttttacttcaatgaaatctgcagtgactgcagaagttcgtttaaatgaattaaccaaagttgaaggtaatgtagtaactttagaaacattaaaagcagcaaatatcttaactaaagatatccaattcgctaaagtaattttagctggagaagtgaaatctgcagtaacggtacgcggtttacgtgtaactaaaggtgcaaaagcagcaattgaagctgctggcggttcaattgaggaataattagcaaatggctaaacaaccaggttatcaagcaagaagtactaatagcggtaaaggtgaattaaaaagccgattacttttcgttttaggtgcacttatcgtttatcgaattggttcattcattccggttcctggtattgatgcggctgttctagctcaattagttgaacaacaaaaaggcactatcattgacatgtttaacatgttctctggtggtgctctaagccgtgcatccattttagcattaggaatcatgccatatatatcggcatctattgtaattcaattgcttgcaacggtttctcctgctttagcagaattaaagaaagaaggtgctgctggtcagcgtaaaatttctaaatatactcgttatgcgacagttgtttttgcaacgattcaggcagtagctatttcaacaggcttaccaaatatgttgtctggcttagtgccaaatgttggatttagtttttacttcacttcagttgttagtttagtcactgggacaatgttccttatgtggttgggtgagcaaataactgaaagaggtattggtaacggtatttcaattcttgtttttggcggtattgtagctggtttaccatcggctattcttcaaactattgagcaggctcgtcaaggacagatgcatccatkagttcttcttctgatcgcagctattgtatttgcagtaacttattttgttgtttttgttgaaagaggacaacgtagaattcgcgttgaatatgcgaagcgtcagcaaggtcgtcaaattttaggtggtcattcaacacatttaccattgaaagtgaatatggcaaatgtaatgccagcaatttttgcttcaagtattattttattcccagctacattaacacaatggtttgggcaaaatgataaatttgaatggttaaataatttatcaatgttattgaatcctggtcaaccactttatttgcttgtttatgctgttgcaattattttcttcagctttttctatacagcaatgcaatataatcctcgtgatacagcagataatctaaaaaaatctggtgcatttattccaggaattagacccggtgaacaaacatcacgttatattgataaagtgatgactcgtcttacattaattggcggtctctatgtaacgtttgtatgtttagttccttatattatgacatcggcttgggatgttaaattttacttcggtggaacatctcttttaattgtagtcgttgtaattatggatttcatcgttcaggttcaaagtcatttaatgtcttctcaatatgaatctgcgttgaaaaaagcaaaccttaaaggttttggacaataattgttcatttaaagtaaaaggataagcaatgaaagttcgtgcttccgtaaagaaaatgtgtcgtaactgtaagattgttaaacgtgagggtgttgtacgcgtattgtgtagcgaccctaaacacaaacaacgtcaaggttaattaacatttttcttgccaagaaccngttgagtagttatactgctcaactcatttatgtccttgatattctgtttgagtatcctgaaaacgggcttttcaagatcagaatatcaaattaattaaaatataggagtgcatagtggcccgtattgcaggcattaacattcctgatcataaacacgctgtaatcgctttaactgccatttacggtattggtaaaactcgttcacaagctatttgtgcagcagcgggtattgctgaagatgttaagatcagagaattgtctgaagagcagattgacaaactgcgtgacgaagttggtaaatttaccgttgaaggtgacttacgtcgtgaagtaacactaaacatcaaacgtcttttagacttaggatgctatcgtggtttacgtcatcgtcgtagtttaccagtacgtggtcaacgtactaaaactaatgcgcgtacccgtaaggtccacgtaagccgatcaaaaaatagtcggggtaaataagaatggctaaaacaccagttcgtgcacgtaaacgtgtaaaaaaacaagttgtagatggcgtacgacatattcacgcatctttcaataatacaatcgttactattactgaccgtcaaggtaatgctctagcttgggcaactgcaggtggttcaggtttccgtggttctcgtaaatcaactccgttcgcagcgcaagttgcggcagagcgttgtgctgaaatcgttaaagaatttggcttaaagaacttggaagttatggttaaaggtccgggtccaggtcgtgaatctacaattcgtgcgttaaacgcagcgggtttccgtatcacgaatattactgatgtgactccgattcctcataacggttgtcgtccaccgaaaaaacgtcgtgtttaagacgtataggatagttggagaaagaaaatggcaagatatttgggtcctaaactcaagctcagccgtcgtgaaggcactgatttattccttaaatcaggcgtgcgtgcgattgattcaaaatgtaaaattgatacagcaccaggtcagcacggtgctcgtaaaccgcgtttgtctgactatggtagtcagttacgtgaaaaacaaaaagttcgtcgtatctatggtattttagaacgtcaattccgtaactactataaagaagcaaaccgtttgaaaggtaacactggtgaaaatttattagtgttattagaaggtagattggataacgttgtttatcgcatgggatttgctacaactcgcgcagaggctcgtcaattagtgagtcataaagcaattgttgtgaatggtcgtgttgttaatattccatctttccaagtttctgtaaatgatgtagttgctattcgtgaaaaatcgaaaaaacaagctcgtattaaagcatcattagaattagcagagcaaagagaaaaaccaacatggttagaagttgattctgcaaaaatggaaggtgtattcaaacgtgttcctgaacgttctgatttatcagcagacattaacgaacatctgatcgttgagctttactctaaataatagttaagcttaaaaccaaagagaggataaaatgcagggttctgttacagaatttttaaaaccacgtttagtagatattgaacaaattagttcaacacatgctaaagtgatcttagaaccgttagagcgtggttttggtcatactctaggtaatgcattgcgtcgtatccttctgtcttcaatgccaggttgtgctgtaactgaagtagaaattgatggcgtattgcatgaatatagtagtaaggaaggtgttcaagaagatattcttgaagtacttttgaaccttaaaggtctagcggttaaagtacagaataaagatgacgttattctgacattaaataaatctggaattggccctgttgttgcagcggacattacctatgatggtgatgttgaaattgtaaatccagatcatgtgatttgtcatttaactgatgaaaacgcttcaattagtatgcgtatacgtgttcagcgtggtagaggatatgttcctgcttcatctcgtacacatacgcaagaagaacgtccaattggtcgtttgcttgttgatgcttgttatagtccggttgaacgaattgcgtataatgtagaggcagctcgtgttgagcagcgtacagatttggataagctcgttattgagttagaaactaatggtgcacttgagccagaagaagcaattcgtcgtgcagcaacaatcttggcggagcaacttgatgcattcgttgatttacgtgatgttcgtcagcctgagattaaggaagaaaaaccggaatttgawccgattttattacgtcctgtagatgatttagagctgacagttcgttctgctaactgtttgaaagcagaaacaattcattatatcggtgatttagtgcaacgtactgaagtagaattattaaaaacccctaatcttggtaagaaatctcttactgaaattaaggatgttcttgcttctcgtggcttgtcacttggtatgcgccttgaaaattggccgccagcaagtattgctgaagactagtttggtcataggttaagattttyctgagaaggataagatcatgcgccatcgtaagagtggtcgtcaactaaaccgtaatagtagtcatcgtcaagcgatgttccgtaacttagcaagtgctttagttagtcatgaaatcattaagactactttgcctaaagctaaagaattacgccgtgtagttgaaccgttaattacattagcaaaagtagatagcgttgctaaccgtcgtttagcattcgctcgtactcgcaacgttgaaactgttgcaaaattatttaatgaattaggtccacgttttgctcaacgtgcaggtggttacactcgcattttgaaatgtggttttcgtgcaggcgataatgcaccaatggcatacattgagttagttgatcgtccagaagttgctgaggcaacaactgaggaataaaaattaattctaaaaagaagctcactttatatagtgggcttttttattttatatattaaaaaaatctttatctgatttaatcattacttagatatattatttacaatcagcgagcagtggtaaattttaagagcatattcgtagatgtcgtgtatttttatctaaattccttgttttttaagctctctactaatacgaattgcggtttcagtttcacatccacaaaattccgctgcttctcggtaggcccaaggataatcgggataactttcagttaaattttcaatggcatcaataatacgttcgtaactacgcttataagctgtattacttattcggtgttctgcatcaataattcattagaaagttgtttcataagataacaagaaaaatcagggttatttgcaataaaatttgcgtgattaccaggaaatattctaactatatcggcttccattaatacttttgcactgcaatgataagatgtttcactaaaaatagtacgaaaaccaaaatattcattagcgtgataaagtcgagtcaatgtttctttgccattttccagactatgatacagaccaactagcccttgttttaaaaaataaaattctttaggcttctcgccttgtgcataaattaagctgtttttttctagagttttactctcagaaataatacatttatttaagttttgtggtagataatagggcaatgtaaacataaaggcgtcttttaatatataaataactttagattactatacaaatttctatattttyctgctataagcaaattatgaaaatgtgaagtgtttaacaaaattttgaactagataaatattattttattttgccaaatgattttgcaaatgactttaaatatggttccatatgagaaagtgctgaataatatgcctcacaaagttgattatgtgctttaccaaatccttgaattgtacgatgttttggacatcctccgtgacatgcaaagcgaaacttacagattttacactgttcggaaagaaaagatttcgctgcaccaaaattcttttgtttagtattattatcaaggagctgtattagaggggtttcaataagatttccgagtttatattcaggataaacataatgatcgcaactataaatatcgccattttgttcaataaccaattgatcgccgcaggtttcacgaaaaatacataaacttggttgtaaaccaaggtaagccataaaccattgttcaataaattgaataccaattttgccgatatcattggtataccattcatcaaaaatattaattaaaaattgaccgctcttttgtagaaatcaagacctgctagggttggctcgccgccttgccataggaaagtaacttgttgttgaggcgttgtttcaatataggatttgatataggcttctaatacttcattagtcatagcccgttggtttaagtgaggtttttccaagtaaaagcaatattgacaatctaaattacaaattgaaccagtaggttttgccattaattgaaatgaattcatatctatgtatcctccttattctttttatcatagcagaataattttaactgtatatgatagcgatcataagttgcgcatatgctcttacgtcaaaatgaagtatgattaaatgaatttttaaataggatctaagatggcgtttagtacaatttttatcttactgatttgcggtatttgtaccaatatggtttctgctatttttggtattggcggtggggtattgatggtgccaattttacgtacgttatttcccgaattgccgattcaagttatttcagctacgtcactcaccattgtgatgtgtaccgcattgattaatttattatttttccataagcaaaaaattaaaattgattatatcaatatgattttatggtctattgctatggtgattggggtgcaaattggttttgaattaagtttttatttttctacagcgataattagtttaatttttacggttagtttaagtgcactagcgattaaaacatttttaaacagatcgagaatacaaatagaagtgtttaatatgtctcctatagaacgagctaaaggtagtattagtttttgtggaggaggcttaattgcgggtattacaggtattggaggcggttctattcttgcgccccttgtcgggcaattaaagggggtaaaaacgcaacaaattgccgtttatacgaactatatgatgattattggtggtattggtaatttatatggctatctcacaagagcttttctttatgatgccagtctaagtggccaactaggattaaactttcttgtagttggtgtcgttaccttgggttcatttgaaatgagtttcttctcaatgaaattgcgtggattaatgaatccagttttaacaagaaaattattggcgattattttattttgtattgcagcctatatgtgcattttggaatttgtattccattaaatcgaataaactagacctagttattctaggtctattctctaagtagtgttttcgcaatctctcttgcttgtgcatcaatttcgagtacatcatcaatattttgaatggtataaggcgaaattctctcaattgttttcgaattaatttttgcaatatccataaagccaatttgacgatctaaaaatgcttgtacggcaatttcattagctgcattcattgctgttgtcgcatattgacccgcagcaaaggcatcaatagccagttttaaatttggatagcgattaaaatcaggttcaataaatgtcagttctttgattttaaagaaatcgagtggttctactccagcaaaagtgcggtgaggatatgccatagtttctgcaattggtgtacgcatatctggatttcccatttgagtaatgactgagccgtcaacataccgtaccatagaatgaataattgattgtggatgaataataacttccatttcttccgcacttgcattgaaaagccagcgagcctcaatgtattccaagcccttattcatcattgtagctgaatcgacagaaatttttttacccatagaccaattagggtgtgcaaccgcttgttctggtgttatgttggtgaattgttcaagtggcgtgtaacggaatggtccgccagaaccagtgagtataattttacttacacctaattcagaaagtgggcaaaaaccgattttttcttgtgcttctggcggtaatgattgaaagatagcattatgttcactatctactggtaaaagcttcgagccatagttttttacggcatcaataaaaagctgtccgcaggttaccagtgattctttatttgccagtaatacccgtttacctgctttaaccgctgaaagagtcggtaacaatcctgctgcaccaacaatcgacgccattatctgatcggcatctgggtgtgctgcgagttcgcaaatagctcgtcgtcctgctaatacttccgttggaatatgatgcgcaattaatttttcacgtaaaattttagccgcatttacatcatcaagagccgcaaagtgcggtcggaatttgatacattgttcaaacattgcttctacattttttccgcctacgagtgcaaatgcatgatatttctgagggttattttcgataacagaaagggtactcttaccgattgatcccgttgaaccaagaatgacaatgttttgtttttgcatagaatctttaccgcacttttgttgattacattttcattggtacgtctaaatttgcatacctaataaaataaaggcagacaaaactgtctgcctttcgcattttttatgattagaaatccattaattctttttctttatccgctaatacttcatctacttttttaatgtaaatatctgtgattttttggatttcttcttctgctttatgttgttcgttttcgctgatttctttgtcttttaataatgctttgattttatcattcgcatcacgacgcacattacgaaccgcaactttaccttgttcaccttcgccttttacaattttgattaaatcgcgacgacgttcttctgttaatggcggaagcggaacacggattgtggtacccgctgaagatgggtttaaacctaaatctgaggttaaaattgctttttctaccgcagagattaaagaacgatcaaacacagttacggctaaagtacgcgcatcttctgccactacgtttgctaattggcgaagtggggtcgccgcaccgtaatattcaacttgaattgcatcaagtaaactcggttgagcacgaccagtacgaatttttgaaatatgaccttttaatgcttcaaggcttttttccatacgatcttgagcatcttttttaatttggttaagcattgcattgtcctttttaattgatgaaagttagaacgccgtgattttactggatttttttaaatttttgaatacatttatcagcttgaaaacagataaaaaatgaccgcacttcagttacccaaagtgcggttaatatttttagtatttttaattaagctttaggaccagctgcaattaaagctttgccttcttcgttagttgcatatttaacaaagtttttcacaaaacgacctgctaagtcttcagcttttgattgccattgtgctttatctgcgtaagtatcgcgaggwtctaagattgcagaatctacacctggtaatgctttaggaattgctaagttgaagattggcaattcgcccatttcagctttttcaattgagccatctaagattgcatcaatgattccacgagtatctttgattgagatacgtttgcctgtgccattccaaccagtatttactaagtaagcttcagcacccgctgcttgcatacgttttactaacacttcagcatattgagttgggtgaagggttaagaacgcagcaccgaaacatgctgagaaagttggagttggttcagtaataccacgttcagtccctgctaattttgcagtgaaaccagataagaagtagtatttagtttgttctggtgtcaatttagatactggtggtaatacgccaaatgcatctgcagttaagaaaatcactttagttgcgtgacctgcacgagaaactggttttacaatgttatcgatgtgataaattgggtaagacacgcgagtattttctgtttttgaaccatcatcgaaatcaacagaaccatctgaacgaacaaccacgttttctaataatgcgtcgcgacggatagcgcggtaaatatctggttcattttcttctgaaagatgaatggttttcgcataacaaccaccttcaaagttaaagatacccacatcatcccagccgtgttcatcgtcaccgattaattcacgttttggatccgttgaaagggttgttttacctgtgccagataagccgaagaagattgctacatcaccatctttaccaacgttagctgagcagtgcattgcaccaacacctttgagaggtaggaagtagttcatcattgaggacataccttttttcatttcgccgccgtaccaagtaccgccgattaattgaatgcgttcagtcaagttgaaagcaacaaagttttctgaatttaaaccttgttctttccagtttggattggttactttagaaccgttcattacaacgaaatctggttcaaaatttttgagttgttcttcagttgggcgaataaacatattttttacaaaatgtgcttgccacgctacttcagtgacaatacgtactgcaatacggtcgtgttcgctcgcaccacagaaaccatcaactacaaataagcgtttacgagaaagttggttagtcaccaagtcttttaagctttgccatgtagcttggttcattggcttgttgtcgttttttgctgtttcagatgtccaccaaacagtatcttttgttttttcatctaacacgatatatttatcttttggagaacgacctgtgaagatacctgtatctactgccactgcaccagtcgtagttaaagtacctttttcaaagccttctaagcctggtttagtttcttcttcgaacaattgctcgtagcttggattgtaaacaacttcttttacgtcataaatgccaagagcttcaagttcttttaccactttatttaagtctgtcataagtcacctctaatatataagattaaaatttaactgtggcttattataatggatgtcaatataaaaaaatgttaagtagatctcatttttaaacatttttttaagaactttacctctttttagtgatattgtgatatagagcaaaaatcccgacattgtgtcgggattgtttttaaactcttgttgattttaatttttcaatcgcttctttattaaagaagtagtgtgtgccacaacactcacattgcatatcaatacggcctttatgttcggctaatatttcgtcaatttcttcatcagagatgagcagtaatgcagaactagaacgctcagcagagcagccacagaaaaattgtacatcttgtgctggataaagattaacggtttcttcgtgatataaacgatagagtaactcttctgcagggagaccaaataattcttcatcttttactgttgctgcgagcgtagttaaatgctcaaaatcttctggtgtaccagaaccatcaggcataatttgtaataacatacctgctgccactggcttgccttcatattctccagtacgaataattaattgagtttgaagctgttctgagcgtacaaaataatcttctaagcattctgtgatcgtgggtttatccaagctaattacaccttgatagcgttcgccttcttttggtgcaatagtaatgaccaatacgcctttaccaatcatattatgcagactcatattttcagtgatgttgccatccactcgagcaagggcgcggatttgttgttgatcattaccatttactaatgctaagcgtaatgggccatcgccttgaatttgtacggtaatattgccggcaaattttagtgtggcagtgagtaaattagtcgctaccatcatttctcccaataaatcctgtactgctttaggatactgatgggtatttaatgtatcagtaaatgttttatttaagcgaacccattctccacgaactgcacgatgttggaaaagataacggtaaagtttgtcattgtcttgagtatagtcttgttgattggtcattgattattcctaattgmgataaaaagtgcggtggttttttccgcactttttgtcttgatcgttttatttaagtgtttttgcttataaataggtggcacttagaggcttgtaaaatccaatgtgatctctaagttataatattaattaagcaaatcttgttttggcttctgcaatagcttcggcaacacgcaatggcgatacgccaccttttgcacaacgtttgtctaagcaagattggagagaaagaatctcgtaaacgtcatctcccactacttcactaaattggcggaattcagggatagtcagatcttctaatcctttgcctttctcgattgcataaaccactgtttcgcctacgatatgatgggaatctcggaaaggtacgcctttagagactaaataatccgctaattcagttgcgtttgaatagccttttaacgcagcttcacgagtacgttcaacatttactttcaattcatctaagacgaacgttgccatatctacacagttttgccaagtatctaaggcatcaaaaataccctctttgtcttcttgcatatctttattatacgcaagtggcaagccttttaaggtgattaacatagatgttaatgaaccaattactctccccgttttgcctcgaattaactcacaagcatcgggatttttcttttgtggcattaatgatgaaccagaagtcacacgatcggatagttccacgaaatttgcttctccgctgttaaagataatcatatcttcagcaaagcgggaaagatgtgccatactaagagaggcgatggaaagtaattctacgatatgatcgcgatcagagacgctatctaagctatttctagttgcgaaagcaaaactaagatcgtgcgcaagtgaatcacgatctacagcataagccgtaccagccagcgcaccactaccaagtggacaagtattcatacgattatacgcatctgttaaacgtgaatagtcgcggtcgaacatttccacatatgccatacaccaatgggcaaaagttattggttgagctcgttgtaaatgggtatagccaggcattactgcttgttgtgtgttttctgcggtttgaactaagtgtcgttgcaaattacgtactgattcttgtaattcaatcacacgctgtttgcaccacagttttatatcgactgccacttgatcgttacggctacgaccagtatgtaattttttaccaaggttgcctactttatcaattagcttactttcaacccaactatgaatatcttcagcatcatcttgtaaaattgcttgcggatttgaccgcacttcaacaagtaattcatttagtgcttgctcaagttgatgctgttcttcgatagttaatacattgactttcaccaaggctttggaccaaccaatcgagccttgaatatcctgttctgccaaacggtaatcaaaccgtaatgaatcattaaaatctttaaaacgcttatctgcggcttgtgtaaaacgcccaccccaaagtgccataatttttcctttttgttttaattaattattctattattgtgcatatttattcataaagcaatattctatattaataataaaacaaaaatggacaaaatctttcattttgtccattttatttgtattagtgctatttatagcgtttttgccaaatttttgataaaggatttaaattctttacctaatttttcgtgacgaataccatattctacgaaagcttccatataaccaattttatcgccgcaatcaaaagtttcccctgtcatatgaaatgcttcaacggtttctttttcaattagcatatcaatagcatcggttaattggatttcatcgccaacaccaattggtgttttttctaacaaatcccaaattgctgctgaaaaaacataacgcccaaccacagcaagatttgatggtgcgtcttcaatagaaggtttttcaacaatactattaatttttgcactttcgccgccattaagctcaatgccaccacaatctgcaacaccatagctactcacattttcttgcggaactggggttaccataatttggcttgcgccagtttcattaaagcgttgaatcattgcagcaagattttcttttttctgatctgcactaaattcagctaataatacatctggtaacataacggcaaaagattcatttcctactaaaggacgaccgcataacacggcgtgacctaaacctttcgcattaccttgacgaacgtgcataatggttacattttttggacagatagaacgaacttcttctagaagctgacgcttcacacgtttttccagcatcgtttctaattcaaaagatgtatcaaaatggttttcgatagcattttttgatgaatgtgttaccagcacaatttcttttatgccagcagctacacattcatttaccacgtattgaattaacggtttatccaccaaagtgagcatttccttcggaatcgccttcgtggcgggcaacatacgtgtgccaagaccggcgacaggaataactgctttcatattatcatatccattgtttaactaagaggaacctaaatagggttcatctttcgtttgtttaattcgttggtaaatttcttctcggtgaacggatacttctttaggcgcttcaacaccgagtttaacttggtttccacgtacactcaaaaccgtgatagaaatatcatctccaataagtacactttcgccaactttacgagttaagattaacatcttttatctccttagtttgcatttattagatatcctatcaatcaaggaacggttggcattccaccaaccagcttgtactacagatttttgtttaaccagtcttgtgctactttaattgcttgtgtcacattttctagttgggaacctcctgccattgccatatctggacgaccaccgccttttcctccaacttgttgagccattaaattaacaagttctccagcttttattttggcggttagatcatttgtcactccaacgacgagattaactttttcatctaatattgatgcaaatgcaattacgcctgatccgagttgattttttaaatcatcgaccattacgcgtaatgattttgtttctataccatctaattgttgtgcgataacagaaacaccattgatttttaccgcactttttacaaaataagaacctgcctgcattgcggctttttcttttagaccttgcaattctttttccactttcttcgctttgtcttgaagttgctggattttttccgctaaggtatttacgtctgattttaataagtctgcgctttgggtcagaatgcgttgttgattatgtaaccagtcaatggcattttgacctgttacagcttcaatacgacgaatgcctgcagccactgcgttttcagtaataattttaaataaaccaatatcgcctgtgcgttttgcgtgaataccgccacacagctcaattgagaaatcgcccatggttaatacacgaaccttatcgccatatttttcgccaaagagagccattgctcctttcgcttttgcggaatcaatatccataatatctgtttgaactggaaagttagcgcggattttttggtttactaatgtttcaatttcactcaattgctctttggtaatggcttctggttgcgcaaagtcaaaacgtaaggctttatctgaaacaagcgaacctttttgcacaacgtgtaaacctagaatttgacgtaaggcagcgtgcaataagtgtgtcgctgagtgattgagtgatgtgttgtggcgacgtttagcatccacaatcgcattcactgattgtccaactttcaaacttccttgcgttaattctccaatgtgtccaaatacttgcccatatttttgggtatctttcacattaaaggttacactttgtgtgcttaaatatccgctatcgccaatctgaccacctgattctgcataaaatggcgtattttctaaaataacgaccgcactttgacctgcttcgatactttccactgatttaccatcatagaaaagtgcggtaatttttgcctgagattctacttcagtatagccttcaaacttagtttcgccatctacacgaataacgctgttgtagtccacaccaaactggctcgctgcttgagcacgagtacgttgcgcttccattttacggtcaaacgcttgttcatcaatagtaatattgcgctcacgacatacatcagccgttaaatccaatgggaaaccataagtatcataaagtttgaatgcaacttcacctgaaagaatgccatctttcacttgagaaagggcttcatctaataagctcaacccacgttctagagtgcgagcaaattgttcttcttctagacgtaatagtttttcaacatttgtttgttttgcttttacatcttttccagcttcagccattacatcaattagagttggcacgagtttatagaaaaaagattctttagcacctaataggtgaccgtgacgaactgcgcggcgaataatacgacgtaagacataaccacgcccttcatttgatgggataacgccatcggcgattaaatatgcacaagaacgaatatggtcagcaataacacgtagtgatttgttagttaaatctgttgcgcctacaatttccgccgtttttgcgattaatgttttgaaaatatcaatctcgtagtttgagttcacatgttgcaacacagcagaaatacgctctaaacccatacctgtatcaacagacggacgaggtaatttttccattgtgccatctgctaaacggttgaactgcataaacacaacgttccagatttcaatataacggtcgccatcttcttctggtgagcctggaggcccgccccaaatatgatcgccgtgatcgtagaaaatttcagtacaaggaccgcaaggacctgtgtcgcccattgcccagaagttgtctgatgcgtaaggtgagcctttattgtcaccaatgcgaataatgcgttcagcaggaacaccaacatctttattccaaatattataggcttcgtcgtcagtttcatacacggttacccagagtttttctttaggtaaaccaagccattgtggagaagttaaatattcccaagcaaaattaatggcatcctgtttaaagtaatcaccaaaactgaagttaccgagcatttcaaagaaagtatggtgacgtgcggtataaccaacattttctaagtcgttatgcttaccaccaggacgtacgcaacgttgcgcggtggtggctcgagaataagggcgtttatccattccaaggaacacatccttaaattggttcatcccagcgttcgtgaaaagcaaagtcggatcattttccggcacaagtgagctactctcaactacttggtgacctttgctatggaaaaaatcaaggaatgattgtcttatttctgctgttgttttcattaaaaagaatccttgttacccataataaaaataaaaactaagtcgccctatttttgcatatttttgaaatttataaaaaggctttttgccaaaactccaaaataaaaccgcacttcacgacgctatttgagaagtgcggttaaaatttaagttatttcagattattcaaaaaacaatttcttgttaattattcatctctaagtggaacaaccaacatatcaattttaatcgtattcatcacttgacgtgttgaagacattaacttactccaaaaatcctgatgatgtcccgtcactaataaatccacatcatattgttcgatggcatcacttaaaacttgtcctaaatcgccgctgccactcaatttttctgaaattggataatccacactttcagctaaatctaataaggctttttgtgtttccgtggaaatcctgtcttgcattgaagacatattcacatcaatcaatccagtataaagatccgaaaagttcacatcaacgtggatgatagaaagttttgcgtcgtggcgtttagcaatcccaactgcttttttaagtaaaattggactttcttcagaaagatctactgccactaaaatgtgtttgtacataatcgactccttaactgattggttcggtttttaactggctccaatgctaacattttgagcaataaaaaactgtgtactagatcacaatttaaacatttttattaaaaattcattaaattttcaatgtctgcaatttctttagggacagcagcggttaggattttattaccatattcagtcatcagtaaattatcctcaatgcgcacgccaatgcctttgtattgctctggcacatctgcatcttctgaaatataaataccaggctcaacggtaattaccataccgatttcgagtatccgttgtttatcttggccataactacccacatcatgcacatctaaccctagccagtgacctaatccgtgcatataaaattggcgataagcttgttgttcaataagtgtatccacatctcctttcaagatacctaaatccactaatccttgggttttaattcgaatgacttcatcattggcttgcttaatggaattgcccggtacaagtaattcaatcgcacgtttttgtgcttttaaaactaactcgtaaatttcacgttgaggctggctaaattttccatttacaggaaaagtgcgggtgatatcgcctgcatacatggcaaattcacagccagcgtcaatcagcactaaatccccatcatttagtgggcgatcattttctgtgtagtgcaaaatacaggcgttacttcctcctgcaacaatggaattgtaagaaggaaatcttgcgcaatggcgattaaattcatgcaaaatatcgctttcaatttcatattcaaagcgatttgggcgtgttgtttgcatcgctttaatatgcccaagtgccgtaatttgtcccgcttgttgcattaatcggatttcattcggcgattttataaggcgcatttcgctgagcattggtcgccaatctaaaatctcgctaaaattcaccgcactttctgacaccaatgtatcaccccaagtatgaatttctggcacatggtaaagtgcggtcaaatttttcagtatttttggcagtacggtagcgaattcttcaatagaataggcttcatttacattaagttgctgtggcgcacgctcaacacctaatcggcgaccattccaagtttcaagtaacggatcgcgtggacgaagaaaaataatggctttttctacttgttctgttttcagtaataacagtgctgcattcggttcattaaagcctgttaaataccaaaaatagctatcttgacggaaaggataggtacaatcattattacggcgtttttcgatttcagaaaaaagcaataatgccgaattaggttgcatttgagcgaatactcgtgtgcgacgttcctcaaattcttctttaggcaatttagccatataagccaattccattctagatctccttaatgtaatacaggtttgctctcaatttccccttcgttgaaatgagaatagaacaacattgcaatggtgcgaacatattcaatgatttcttctagtgcttccgcaagctcttcttcattatcatcttcatcataaccaagttggcaaatatcttgtaaatcatctacggcttcgccaatttcgcctttttcttttgctaattcaggttgtgctaagccaatcccaagtaagaattggtttgcccagtcagataggctatccgcttgtgtaaagacattttcatcttcggttaaaccaagttcaaaggtaaatccttcaacatctgataaggtttgactaatttgttcataaagttctgtaacgggttggactaatcctgttggataagcgtgattatcattgctgaattgatataagagcggtagccaactttgatcttttaatccaccacaaagtaaaccgcttaaaaagccgtgtagttctgttgcattaaagccgattccagcagatttaagttgttggttaaggtcagaatgagaaatgagcataatagatttcctgagtaaatttgaaattagtgtaaacctttgtaaataaaaaagccatcgcttgaccaattaaattagattaagaggctggtggtgcgtcacagcttttaacgctagaaatgaacctgatttatagatcttgtaatgacatttttattataaataatggcttatttaaatttaaactctgtccattgataatatcgcccgcctgctttttgaattccgccgtaattttgccattcaggatgatttggcgtatctggtaaacattgagtttctagtgctatgccagaaaaatcggcatataattcgccatttctcgttggtgtacctgcaagataattacccgtataaacctgcaatgcagcttgcgaggttcttacttccaaacttaaatcgccagttggagaggttagtaacacacaaggcttttgccaagctttattgacaataaaggaatgatcgtaaccctttgttgcttgctgatccccttgtaaaaaatcttgcttgatgggtttagcaatacggaagtcaaaacttgtattcaccacgtgctttaatggagaattaggaatcccctcattatctacaggcagataaaaatcagcatttaaacgtaatgtatgttcacgcacgtcactgccttgctctgcattttctaaattgaaataagtatgattcgttaggttcaatgcagtatccttatcgcacatccctgcatattcaatttttacgctattatcacctgttagcgtataggttacagacacatccacattaccaggaaaaccttgatcaccatccactgaatgtaatgaaaaacacacaaaattctcaccgcactcttgaatgttccaacggcgtttatcaaagccctctccaccatgaagctgatgtttaccttgattactacttaatttaataagttcgccattcaattcaaattgtgcatttgcaatacgatttgcataacgccctacgcttgcgcctaaatagctttgatgagtgggataattatctaccttacaacccaataaaacctcgcgtaatgtgtcatttactggcactttacaagaaagccaagttgcgccccaatccataaattgaacacgcatcccattttcattttgcagggttataagctgataaggtgcaccatcaggcgcattaaaagtggtttgttctaacattattttctcttaaatcactcgaacaccttgtgatgcggtacacacataaaaagtttcttttaaaccagtcgttttctcgtaattatccgcaataattttacgaactgaatcgactttatcatgcggtgcaagtgcgacaatacagccaccaaaaccgccgcccgtcatacgtgcaccgccacttttgccaataacaagttgagccaattcaactaaataatcaatttgtggcacggtgatttcaaaatcatcacgcattgaatcgtgagatgcttccattagtttacctaaacaagtcaaatcattgttcttcaatgcttccactgcatcaagtactcgttgattttctgttacgacatgacgagcacgttttgctgctaacggagaaagtgcggtcaattccgcttctcttttttggaattgctcaactgaaacatctcgtaatgctttcacgccaaaaaattttgctgcctcttcacattgctgacggcgagtattgtattcgcctgttactaaatcgtgcggtacgtttgaattcacaataatcacggcgacatcttgtggcactggtgttggcgtggtttcaagactacgacaatcgatcatcagtaagtgattttcctgcccaagtgcggaaattaactgatccatattgccacaattagcaccgacaaattggttttcagccttttgcccattcaatgcaatatccgtgtgagaaagcggtaaatcgccaagttgttggcagaatttacccaccgcaacttctaacgctgcagatgaacttaatccagaagaaagcggcacattaccagaaatcactaaatttgcaccttgttgaaaatctgggtaacgttcttggataaattttaccaccccacgcacgtaattagcccatttgtgttcactcttaggaatttcaacattgagagraaattcatcagtttcatcaagatctgcagcataaacattccaaatatgatcatctcgttttgtaccagaaacggccgtaccaaaattaattgcgcaaggcataacaaagccgtcgttgtagtcggtatgttcgccgatgatatttactctgccaggcgcatagacggtaatttctggcaaatttttatgctgtctattgaaaatttgttgagcattttggattggggtcatatttctatcctttatattaaatctatactcgatctgcacccctctttgctaaagctaaagaggnngactgactatattatttagttctttctttataatgaacttcactcaaagcacgtaatcgctctgctgcctgttctgccgttaaatcacgttggttttcgcctaacatttcatatcccaccataaatttacgcacggttgctgaacgcaaaagaggagggtaaaaatgagcatgtagctgccaatgttcgttatcttctccattaaacggtgccgcatgaaatcccattgaatatgggaaagaggtttcaaagagattgtcgtatttagtcgtcaattttttcaaaataaccgcaagatcttttgattgttcgtcacttaattcagttaaacgttttacatgagtttttggtaaaagcaatgtttcaaatggccaaatagcccaataaggcactaaagcgatccaatgttcagtttcaacgacaatacgttctttcaacgccaattctcgttttacataatcaaccaacattactgagccatgttttagcaaataatcacgttgtgtacgatcttcacgagcaacttcatttggcaagaaactattcgcccaaatttgaccatgtggatgtgggttcgaacaccccattgctgcccctttgttttcaaaaatttgcacccattggtatttcgcaccaagctcacgaagttgttcctgccatactttaatcacttcttcaatctcaagtgcggtcaataatggcaatgttttactatgatcgggagagaaacaaatgactcgactttccccacgagcttgagaactttggaaaagaggatcggaggatttttcaggggctggcgtatcttctaaaagcgcggaaaaatcatttttaaacacataaggtttacgataatctggatttaattcccctgtaatacgcttattactcgggcaaagataacaagttggatcataacttggtttttgttcttcattgactttttcctgttgcccttgccacgggcgtttggcacgatgtggtgataccaaaacccattgatcaattaacggattgtagcgacgatgtggatgttctgtaggttcaaaaagtgcggtcattttgactcctgttttttatcaatgtaaacgattacattaatttatactaaattattgtaaataaaccgtgatctttgtcacaaaataagaaaataagcaaaattttttatgatttagttcatacttatgaaagtaaccgctttcaatttatcgtaaattatttatgatcaaaatataagatttatagattataacaaggaaaaagttatgagtactattcgagatgtcgctaaattagccaatgtatctgtcgctaccgtatcccgagtattaaatcactctctttctgttagtgaaaatacacgccttgtggtggaacaagctattgcacagttagcttatcaacctaatgcaaatgctcaagcccttgctgtgcaaaacaccgatacaattggcgtggtggtaaccgatgtgacggatgccttttttgcgattttagtgaaagcggtggataaagtagcagaagcacatcaaaaaacgattcttatcggtattggttatcatcatgcggaaaaagagcgggaagcaattaataccttattacgtaagcgttgtagttctcttgttgtacattctaaagccttatctgatgatgaattaagccattatttaaatactgtgcaaggaatggtaatcattaaccgtgttattaaaggttatgaacatcgttgtgtcagtttagataaccaaaaaggcacttatttagccacggaaatgcttattcgttatgggcatcaacatattgcatatatcggttcaaatcacgccatttttgatgaagttgaaagaagaaatggttatcttgccgcattaaaagatcacaattatcccatcattgaacaggcgataacactcaatagcccagactttgaaggcggcgaaaaagcaatgattgatttacttagttataacaaaaatcttacggctgtcgttgcttataacgattcaatggcggcgggagccatttcagttctcaatgaaaacaatatcagcgtaccaagccaattttcaattattggttttgatgatatgccgattgcccgttatttgatcccaaaactaaccacaattcgctatcctattgatttaatggcaacttatgcggctaaattagcattaagtctaactgacgagaaaataattacacctccagtagttcaatttaaccctactttggtacgccgtttttcggtggaatcgcgctaatttgtgacatggatcacaaattcataattttttatgtaatcattttcatttttgcaaatttgctcatagattaattacgataatttatttatgatgtacacaaccttatctatccacatcaaccttccaaataggagtgttattatgaaaaaaacagccgtgttaagtaccgtcgctttcgctattgcattaggttcagcatctgcaagttttgctgcagataatcgtattggggtcacgatttataaatatgatgataactttatgtctttaatgcgcaaagaaattgataaagaagctaaagtagtcggtggcattaaactcttaatgaatgactctcaaaatgcacaatctattcaaaatgaccaagttgatatcttactctctaaaggcgtgaaagcacttgcgattaacttggtggacccagcggcagctccaactattattggcaaggcaaaatcagataatattcctgtcgtattctttaacaaagaccctggtgcaaaagctatcggttcttatgaacaggcttactatgtaggtactgatccaaaagaatcaggcttaattcaaggggatttaattgcaaaacaatggaaagcgaatccagctcttgacttaaataaagatggcaaaatccaatttgtattattaaaaggcgaacctggtcacccagatgcggaagtgcgtacaaaatatgttatagaagaacttaatgcgaaaggtatccaaactgaacaattatttattgatactggtatgtgggatgctgcaatggcgaaagataaagtagatgcttggttatctagctctaaagcgaacgacattgaagtcattatttctaacaacgatggtatggcattaggtgcgttagaagcaacaaaagcacacggtaaaaaattacctatctttggtgtggatgcgttaccagaagcattacaattgattagtaaaggcgaacttgcgggtacagtattaaacgatagtgtaaaccaaggtaaagcagttgttcaattatctaacaatttagcacaaggtaaatctgcaactgaaggtacaaaatgggaattaaaagatcgtgttgtacgcattccttatgttggtgtggataaagacaacttaggtgacttcttaaaataatttcccatcaatttttgttgtaatctaaggggaagtggatcttcccctttttaaagaggttggatatgacagctcaaactcaatgtcaagacagccaagtgctgctcacaatgaccaatgtctgcaagtcctttccgggcgtaaaagccttagataacgccaacttaacggttcgatcacattctgttcatgccttaatgggcgagaacggcgcgggcaaatctacattactaaaatgtttattcggtatttatgccaaagatgaaggcgaaattcttttcttaggcgaacccgtcaatttcaaaacatctaaagaagcccttgaaaatggtatttcaatggtgcaccaagaactcaacctcgtgcgtcaaactagcgtaatggataatttatggcttggacgctatccacttaaaggtccttttgttgatcacgccaaaatgtaccgtgatactaaagcgatttttgatgaattggatattgatgtagatccgaaagaaaaagtcgccaaactttcagtttctcaaatgcagatgatcgaaattgcgaaggcgttctcgtataacgctaaaatcgtaatcatggatgaaccaacatcctcgctttctgaaaaagaagttgagcatctgtttaaaattatcgacaaattaaaacaacgcggttgcggcattatttatatttctcacaaaatggatgaaatcttcaaaatctgtgatgaaattactattttacgcgacggtaaatggatcaacacggtaaacgtgaaagaatccacaatggaacaaattgttggaatgatggtagggcgtgaattaacacagcgtttccctgaaaaaaccaacgtgccaaaagaagttattttgcaggtggaaaatcttaccgctaaaaatcaaccatccattcaagacgtatcttttgaattacgcaaaggtgaaattctcggtattgcagggcttgtgggggctaaacgtaccgatatcgttgaagctatttttggcgtacgtgaattaatcgaaggaacgattaagttacacggaaaaactgtgaaaaatcataccgcacttgaagcgattaataatggctttgcattggttactgaagagcgtcgttcaacggggatttattctaatttaagtattgagtttaattcattgatttcaaatatgaaatcttatctcactccgtggaaattacttagcacgaagaagatgaaaagtgatacccagtgggtaattgattcaatgaatgttaaaacaccatcacacagaactacaattggttctctttctggtggtaaccaacaaaaagtcattattggtcgttggcttttaactcaacctgaaattttgatgctagatgagccgactcgtggtatcgatattggggcaaaatttgaaatttaccaacttattcaagaactcgctaaaaaagataaaggcattattatgatttcatcagaaatgccagaattactgggtgtgactgatcgcattttagtaatgagtaacggtaaattagcaggtatcgttgaaagcgcaaaaacatcgcaagaagaaattttgcaactcgcggcaaaatatttataaacataaggaatgaattatgagtgccttagaaaaaaacaaatcctttgatctcttaaaacaaaatgcgatttattttgtgttattgattttgctcggcatcatcattgcacaagatccgacattcttaaatttagtcaatttcagtaacatcttaacccaatcttctgtacgtttaattattgctttaggggttgcgggtttattgattacacaagggactgacttatctgcaggtcgtcaagttggtttggctgcagttatctctgcaacaatgttgcaatcaatggaaaatattaaccgcgtgttccctgaaatgggacaaataccaattccagtggttattctcgcagtttgtgctatcggtgcagtaattggtttagtgaatggtttagttatcgcttacttaaatgtaactccattcatcgcaaccatgggtacaatgatcatcatatatggtttcaactcactatactatgatgctgtaggtggttctccaatcgcaggttttagtgaaaatttctcaacatttgctcaaggattcttccgagtcggcagctttaaactctcttacatcacgatttatgcagctattgcagcattattagtatggattatgtggaacaaaactcgtttcggtaaaaacgtatttgctatcggtggtaacccagaagcagctaaagtatctggtgtaaacgttgcacgtaacttagttgcaatctatatgattgcaggtatgttctatgcctttggtggtatgcttgaagcgggtcgtatcggttctgcaactaacaacttaggttttatgtatgaattagatgctatcgccgcttgcgtagtgggtggtgtatcttttgctggtggggtaggtacagtaattggtgttatcactggggttattatctttactgttatcaactacggtttaacttacatcggtgtaaacccttactggcaatacatcattaaaggtagcattatcattctagcggtagccattgactcgttaaaatatgcgaagaaaaaataaagctgacgcaatcttaataaaatgaatgaaaagtgggcaaatttgtccacttttgttttatctattcaattctgaattaaggatatttatgcaataatcggcaaaccctgtataattgcgccaccattttcatagagagaaaaaaatgctaattaactttacacaagtattgcaagacagttggaatttcttccgtaatcagaaaaaaattatgctgcaatttgtcgcaattttatttattgtgcaaagcgcgagcgcacttttaagtttttcagttaatgatgaaaataaaaatgatgtattaaatctcgccaatacagatatcacaagttttatcttttcagttgcaatcactcaaattttaacgagctttattgcagcttggggattaacctcaatccataaaattagcctacaaaattaccgcactttaggtgaaaccttctcacttaccttgcgccgttttgcaggcgtaattctgttagatctattaatggttgcaccaatgttacttggtcttggtgaagcctttgctgcattactcacaaaaaaatcgccctctattatgtcacttatcgcgatgcttgttggcgtttggttctttgtccgtttaaatttaacggtagtacattatctttctactcaagaggcactttcgcaaactatccgaaaaatttggatgcgaggaaatactcgaaaaggcgtattgtttatttacaccctactggtttattttctcgtgccaattcttattttccaattaagcgcattttccaataatgctgtatttgatatggtaataggcattttcaccgcattacttaatattttcatgctagtagtgacttatcgtttctacagcttatttatgaaggattaatcaatatgaaacaactccttgactttatccctttaattttattttttatcacttacaaactcggtggtgtacgtgaagcagccatcgtattagtggttgcaacaattttgcagatcgtgattttaaaatggaaatacggaatggttgaaaaacaacaaaaaattatggcaagtgcggtcgttttttttggacttttaaccgcttactttaatgaaatccgctatttgcaatggaaagtgacaattatcaatggcttatttgctattgttttgctcgtcgcacaatttcaatttaaaaccccattaatcaaaaagttacttggtaaagagctacaattgcccgaaaaggcttggaatacattgaattttggttgggcaatattctttattatttgtatgttggtaaatatttatatcagccataatatgtcggaagaggcttgggttgatttcaaatctttcggaattattggtatgacagtgattgcaaccattatttcgggagtttatatttatcgttatttgcctaaagatggctcaaattcaaaagacggagagaaataatgtctgccaattttactgataaaaatggtcgccaatcaaaaggagttcttttactacgaactttggcgatgccttctgacaccaatgctaacggagatatttttggtggctggattatgtctcaaatggatatgggcggcgcgattttagcgaaagaaatcgcacacggacgcgtggttactgtcgccgttgaaagtatgaattttatcaaaccaatctctgtgggcgatgtggtttgttgctacggtcaatgtctcaaagttgggcgttcttccattaaaattaaagtagaagtatgggtaaaaaaagtggcgagtgagccaattggcgaacgttattgtgtcaccgatgcggtatttacttttgttgcagttgataataatggtcgctctcgcacgattccccgtgaaaataaccaagagttagaaaaagcattagccttaatttcagaacaacccttgtaaataaaaggaaatcattatgtactatgttatttttgcccaagatattcccaatacgttagaaaagcgtcttgccgtacgcgagcaacacttggctcgtttaaaacaacttcaagcggaaaatcgcttactgacagcaggcccaaatcctgcaattgatgatgaaaatccgagtgaagctggttttacaggttcaaccgttattgctcaatttgaaaatctacaagcggcaaaagactgggctgcacaagatccttatgtagaagctggcgtatatgcggatgttattgtaaagccgtttaaaaaagtcttttaatttaaataacgtaatatgaaaaaagtcgccttaatttctctctgtatttttaccgcactttctgcttttgccgattcgcctaatacggcaacagcatcaatcaatcttgagcaagagaaacaaaactgggagctggcgcagcatcaagattatttaaaacgtctaaaacaacgtgaagtctttttgcaagttgaaggtttgctaaaaagtgcggtaaaaaaacagcaattttctgaagcgactcaaaatatcacaaaaaccttaatagactcattgcaaggctaccctttgcaatatgatctgcttgctcgattttgggagacaaaaatcgcctttttgcagaatgatgatattcaaggaagacaacaagcaataaatgaactcaatgcgttagtgcaacaaaattacccttttgtgacgccagcatttcaagccttattacaaaaactatccacgttaaacgaacaacaaacatcagcaacttcagataatgctaaagaaaataacagggttcaaaaagagcaaaatcaagtagaaaatcctaaacaacttgctgaaattgtaagaaaaagtgatcctaacactttagataaaaccgtattaattgatgctttcccacgttatcttaaaacgctacctgaacaaatgaataacctaagttttgaatcctatcaaaaatgggcaaatacttggcaactctcagaagatgaaattaaacagtggaaaatagcctttttaaatcgtttttttgataatgaaaacactgattttcaaaaatggcgtgatgaacaaatccgacaattacagactgataatttaaccgaacgccgtttacgaatggcaatttggcaaaaaactgaattaacctcttggctaaatttgctttctgccgaatcaaaaagtaagcaagaatggcgttattgggaagctaaacaagatatattaaaaaataccaaaaaactgaccgcactttcaaaagagcgtggcttttatccaatgttagcggctacacaattaaaacaagcatatcaactgaatgtccctattgcgccaagttttactcaagctgaacaacttccttttaagcaagtttttgcaatgattacagaattaagagaacttggacgaaatggtttagcaaaacaacgctggcgaattttacttgataatgttgatttcacaactcagctaaaactttctgaatatgccaaaaatcagcaatggtttgaattagctgttgatgcttctattgttgcaaaagcgtgggattacctgtctcttcgtctgccaaatgcttattctgaatacttcaatgctgcattacagaatttgaatatcagcaaaacttttgctatggcaatcgctcgtcaagaaagtgcttggaatccaatggcacaatcttcagcaaatgctcgaggcttaatgcagcttttgccaagtacggcaaaattgactgcagagaataatcaactaccttatcaaggcgaacaagatttattcaaaccattgaataatattttgctaggtaccgcacatcttaatgaactcaatggaaaatatcctaataatcgaatattgattgcagccgcttataatgcaggggcaaatcgagtaggaaaatggttaagtcgtgcgagtggaaaattagcattagatgaatttgttgcatctattcctttttatgaaactcgtggttatgtgcaaaatgtagtcgcttatgatttttactatcaaattttgcaaaataaagaaaacccacaaatctttagccaagaagaattgaatcggctatactaaatgcactagtttaatagtgtaaaatgggagcataattatgtatatcagccgtaatttagagcaatggaatgcatttcttcaaatgctaaaaattgcctttgaagaaaacaaagcgcaggaatttctaaccttattattaactgcagacgaacgagatgctgtaggattacgcttgcagattgtctctcagctgattgataaaaatatgcctcagcgtgaaattcaacaaaatctgaatacaagtgccgccacaatcactcgaggttccaatatgattaaaacgatggatcctgattttatgcaatggatgaaacaacatcttgatctcattgaaaaaaactaagcgaatttttaccgcactttctcacttatttagtcctaaatggtggaaaaaaaactggcagcgagttgtcttttgtttttttttcgccgtttttgctttgttgctgatttttcgctttgtacctattccattttccgcttatatggtacaacaaaaaatcgctaatcttttacaaggtgattttcgatatcaaatccaatataactgggttagcctagaaaatatctctccaaacattcaattagctgtgatttcatcagaagatcagcgttttcttgaacatttaggctttgattttgaggctatccaacgagcaattcggtataacgaaaaatctaacaaaggaatccgaggggcatcaactatttcccagcaaactgctaaaaacttaatgctttggcacggacaaaattggctacgaaaaggtttagaagttccagcgactatgttgcttgagctgacttggtcgaaaaaacgtattttagaagtgtatttaaatattgcggaatttggaaacggcatttttggtgtggaagcggcaagtcgctattactttaaaaaatcagctaaaaatttatctcaaaatgaagccgcacttttagctgctgtgttgcccaatccaatcatttataaagtaaataagccaagcttattagttcgtaaaaaacaaacttggattttgagacaaatgggaaatttaggcactgaatacttgagccatttataaaaaatgcaatcgaatttctaaagtacaacaaactaaaaaatatttacttaatacacaaaataaaaaacgagtctaagactcggttttttatttataacatttttattacaagtttattaccgcaaataacacccaaacggtataaattgtggctaaaccataaaagataaatccaccagctggcacatgcactttaagatcgtgcataccgtgatgaatacggtgtaaaccacaccacattgggaaaatagtaagcactaaaataactaatttaccaatccaagaataagcaaaagtaattaaattatgcacatcgactaaaccaaatggtaataacaaaccgatgattagaataacgacaggaaggaaaattgcactcactgtgccgcccgcaccgaacattaaccatactggcggttcgccggagcgttttggattttgatcaaccattttttctctcccttaaatataaactaaaactaacgcaatcacgctaactaatgcggttaccgcccaaagtgcatttcttacaactgtgtgtggtaagcgttcatttttcacaatgatattcatcacttttggtgtcattaagaaatatgtcaccgtatgataaagcgttgcgataagcgtaataatatttaagaacactacaatagggtttcttaaaaactcaataaagctcaagatgcctaagcctggcattggattgcttgcaaaacaaagaacaccataaagcaatacaatacaaaaccatacagcaaagactgaagtcgcttcacgtagcatataagctttgtagaagtccaatttttgccaccaagtcgctgtcattggacgaacatattttttacgtttactcactgttactgacattccttcccccttagccttttggttttagcatagagataacataatctttggcactttccacttttccttggttaattgcagaagcaggatccacatgttttggacaaacttctgagcaatagccaacgaaagtacaactccaaaccccgtttttaccatttaataatgacatacgttttgctttaccatggtcacggttatcaagattataacgatgagccatcgtaatcgctgctgggcctaagaattcaggatttaaaccaaattgagggcaagcggcatagcataaaccacagttgatacacattgagaattgacgatatttctcaagctgtgctggcgtttgtttagtacggctaacttgcaattctttcgatggatgtggtttaccatctaatgctggtgcttcgttaccaataatataaggcttaattgcctctaaactttcgataaagtggcttaaatcaaccactaagtcgcgttcaatagggaagtttgctaatggctcgatacgcatatggccgctgtaatcacgtaagaaagttttacaagccaattttggtttgttatttaccatcatcccgcaagaaccgcagatcgccatacggcaagaccaacgataagaaagagatggttcaagtttatccttaatatagcctaacgcatcaagcaatgaagtttgattatcataaggtacttgataggtgcttaaatgtggctcttgatcgatttcaggattgtagcgtaatacttcaacattcattactggtgaattagccatttgcttgctccttagctttcgcagctgcttcttgagcttctgcttccgcaccgtaaacacgttttgcaggttgagatttagtaattttcaccggactgtattcaatgcgcggcgcaccattctcattgtagaaagcaagtgtgtgttttaaataattgacatcgtcacgttctgtgtaatctaagcgttggtgagcaccacgagattctttacgttcaatcgctgaatttgcaatagattgcgcaacatctagaatgtaacccaactcaacggtgtaaagtacatctgtattgaacacgcttgaattatctgatacgcgaatacgtttgtaacgttcttttaactctgcaattttatctactgctttttgcatacttgcttggtcacggtaaataccacaaccttcttccatcacggtacccatttcatcacggatttcagaccaagattcattaccttcttgtttgtgaagagcttctaggcgagctacaacgtcttttgcttgagcatcaaccgcactttgatttacagattgagcttcaactgcacgttgtgccgcatactcccctgcaacacgacctaacacaacaagttcagctaaagagttagatcctaaacgatttgcgccgtgtaaacctgaagatgcacattctcctacagcaaataaacctttgatacgtgtttcgctgttaaaatcaacttcaattccgcccatggtgtagtgaacaactggacgaacagggattggttcattcactggatttacaccttcataagcacttgctaattcacaaatgaatggcagacgctcatgtaaatatttttcaccaagatgacgtaaatctaaatgcaccacatctacgcctttcgcggtttttaaggtattaccttttttccattcttgccagaatgcttgagaaactttatcacgagggccaagttccatatatttattttgcggtttgccaattggtgtttcaggacctagaccgtaatcttgaagatagcgatagccatctttattcactaagataccaccttcaccacgacaaccttcagtcattaaaatacccgtattaggtaagcctgttggatgatattgaacaaactccatatcacgaagtggtacaccgtgacgatatgccatagataagccgtcacctgttacaatgccgccattggtattaaatttaaatgcacgacaaccaccaccagttgcgataacaaccgcattggcattaatttgaacaagtgaaccttccatcatattcattgcaaccataccacgagcatggccatcatcaacaagaatatctaatacgaagtgttcatcaaaacgttggatttgtggatattgaatagaagtttggaaaagcgtgtgtaataagtggaaacctgttttatctgcagcgaaccaagtgcgctcaattttcattccaccgaaacsacgtacgtttacatcgccatcagctttacgactccaaggacatccccaacgttctaattgagtcatttctacaggggaatgttgcacgaaatattccactacatcttgctcacaaagccagtccccaccagcaacggtatcttggaagtgtttatcgtaagaatcttcttctttgataactgccgctgcgccaccttctgctgctacagtatgcgtacgcattgggtatactttagaaactaatgcaatttttaagttaggatttgcttctgctgcggcaatcgctgcacgtaaaccaccgccaccagcaccaacaatcgcaatatcgacattaactgtttgcacgatatcctccaatcaatagaaagtaaaaataaatcccctaaaagggtaatattgtgtgggcattgtgccatttttcgttacaaattaataacgtnttttatgtctaaagatggaaangtatcggattttgtgatctacctcaaaaaagctaagattgagttgagagtagctctcgtttacaatgtgcaaaatttttaaaacaggattaaaaatgaccgcacttaatcattggcaaccttctgctgatataaaaaatctycttaaacgggcaaaaattattgctaaaattcgtcaattttttacagaacgcggtttgcttgaagtagagacccctgttctaagtgaatttggcgtcactgatttacatctttccacctttagcacggaatttctcgcgcctttcggtgaacaatccaaaacactttggctttctacaagccctgaatatcatatgaaacgcttgcttgctgcaggcagtgggccgatattccaaatcagtaaagtgtttcgcaacgaagaggctggaaatcgccataatccagaattcactatgttggaatggtatcgaccgcactttcatatgcatcgtttaattaatgaagtagatgatttgctccaacaaattttagattgtccacctgcagaaagtttaagctatcagtttgttttccaagaatatgtaggcttagatcccttgtcagcagaacgttcagaattaattgaagcagcacgtaaacataattttatggctgaagataatgaagatcgcgatacgttattacagtttttatttagtgaagtcgttgagcctcaaattggaaaagaacgacctattgccgtgtatcatttcccttcaacacaagcagctctagcacaagtaagcccagaagatcagcgggtagcagaacgctttgagttctattataaaggtttagaattagccaatggttttcacgaacttgccgatgcgcaagaacaacgtcatcgctttgaattagataatcaacaaagacaaaaatgtgaattgcctactcgagaaattgatgaacgctttcttgctgccttagaagcgggtatgccagatgcttcaggtgtcgcattaggaatagatcgtttaatgatgatcgctttagattgtgaaaaaattaatgacgttatttcttttgctgtggacaatgcttaaaggtaaaagtgcggtaaaaattatcatcatttttatttaatgggtgatccataatggcaattttatattcattgatagcccgcctaatatttctttttgataattaacaatattcgcttcttttaatgggggaataaattctgagatcgaaattaggtacagtgatcacaaggctcatcattatgaaaaaaagaaaaccaaaacataagaaatgtttggatagtgagttgatttaaattgaaaaaataacctaatttcataaaaattaggtaactaaagcgtatccttttccgcgtaaagttttaaaccaagagggcttgttttttcgttttggtaatttgcgtcttaaattagagatgtgcatatcaagagaacggtcaaatggagtgagcggtttttccattacttctaaacttaattcttctcgacttaccacatttcccttagatttaagcaataaacaaagaatcttaaattcataatccgttaaatttagattttcttcattataggttgcaattccgtgagaaaagtggagagtaattccgtcaaaagaaaggatttctacatttgatatattatttgaaggagatgcactacgacgcaaaatcgccttaattcttgcaataagttcacgatcgttaaaaggcttgggtaaacaatcatccgctcccaattctaagcctaatacgcgatcaatgtcttcgcctcttgctgttagcatcatcactggcacgttagagactttacgaatttcttttaatgtttcgataccatttaactttggcatcattacatcaagtaaaaccagtttatagctttcattgagtttttgtaatgcttctaatccattatttgcagtttcaacgtcaaaaccctcaagttctaaaagtgtagaaagtagttcagttaattcaatatcatcatcaacgagtaagagttttgacattggagattccttttaccaattattcttattgtagtgtggtgaaaataaaaagattatttccagaatttccaccagcttgattttggtttctcacctgtttcaataatggtgttattttcgccttgttgtgaaacctgtggtaaaggtttatcaagatgggtttctgtcacaatcccacgttgatcaaattttactgtgaaagtatgttgaactggcgtttcataggcacgttgttgtaagaacacatagtaccaagtctgactattataaggatcgactaatactggcgtacccaacaaatattgtacttgttgagcagtcattccttctttaacttgcgcaacggtagtcgcctctaaatagttgccttgcggtacatcaattcgatatacaactttttcaacggtggaacaagaagcgaggcttaatgctaaaaaggttgcgcctaaaagtgttttaacttgcattttctttaccttaatttgtgcaaaagttctgtcaaataatatccaaaattgggtgtatttccaaattaattctctgattttaaagccttttgtaattgatcttttaaatttggtggtaagcctttgatggttagggtatctgtcataggatcccattgaatacgtgtattcaataattccgcatcaaaacttagggtaacgccctttcctgacccagagaattttgttagcgatttcaatgttgaacgtattggtggaatactctcttccaaaccataattctgtttttccgtaaagacgacaaaaggctgttcgtttagagtgggtaatgaatcagaaagttcccttaattcaatattgttaccatttgaaagctgacctttacaatattcaaacacttgtttttttaccgcttgagtttgctctttgttgagttcgccttgatcgcagtaatcactcacagcttgcaataaacattgattttgaacttgtggatttaatccttcttcggcacctaaaaaatccataaaaaaatcactaattttgcgaccaacacgaccttttataaaggttaaataacgattagagttcgcatttacttgcaaatccgtcaaatttatccgtgccgcaatatcaaactgagtaatatccaaatattctgtacggcgaatatctaaatgctcatcgactaacatactatgacgactatcaagcaatgcaataaacaagtaatctgtcgctaagaaattatattgacataaaatcaaggtgccactttccgcaaagttatatttacctagctcatctgcaagcaattttgttgaatattgactaaaacccaaaaactcaatttcttgctctaataaacgatttaaatgttgtgcaaatatagacttttcctgaaacacgccaaaagccttagctttattttgatagctttgatgcaattgcaacatcatttgttctacttctggtgtaatggacagcaactcgtcgcgtaatacgctttccatttttatactgtcgccatccacatttttgactaactgatgcaaaacagtttgattaacggtaatactcatttttgtcacctttgaaaaatttgccgcaaattataaccgcactttttcagcaagaaaaaagaaattatttaggttctaccaaataatcgggtatcataagccaaattttttttatttttaacattatggctcaacattctaaatattctgatgctcaattaagtgcgattgtaaacgatatgatcgcagtgctagaaaagcataaagcccctgtagatctttcgttaatcgcactgggtaacatggcgagtaatttattaaccaccagcgtgccacaaactcaatgtgaggcattagctcaagcgttttcgaactccttaattaatgcggtaaaaacacgttaatatgaaatggattaaaaaaggcaccttcagcggcaaacaataccgcgatgacgtttcacgaaaaatttcgtggggtcattggtttgccttttttaatatcattgttgctatttttattggcgcacgttatgcctttatcattgactggccagatactctcgcaggaaaactttatttctttgtgagtttgctcgggcatttcagtttcaatgtttttgcgttgtacttactcgtggtctttcctctgagtttcattgttaaaaatcaccgcacttttcgcggattaaccgtgattttttctacgatttgtacaaccttattgttatttgataccgccgttttcaatcgttttaatctgcatttatcctctgttgtatggaatttgctggtcaatccagaaaatggtgaaatgtcacgcgattggcaaattttctttgcacctatgccaataattttactggcacaaatgttattttctcgctggagttgggaaaagttacgtagtcttgaacgccaaaaatggctaaaaggcactggtatattcttaaccacaacattcatcgcgacgcatttaatttatgcttgggcagatgcttatttgtatcgtccgatcaccatgcaacgctctaattttcctttatcttatccaatgacagctcgttcttttttagaaaaacacggtttcttggatggggaagaatatacgcaaaaattggcgcaagaaggtcgtttagatgctttaaaaattgattatccgaaaaaagaactcacttacgcaccaattacgcacaaacctaatattctgctcgtaacggtttcgggtttacgccatgatgcgatttctaatgaaaagatgccaaaacttgctaaatttgcaacaagctcaacggaatttactaatcattacagcacaggcaatagtaataacgcaggcttaattgggttattttacgggctaaatgcaaattacaccgatagcattttaagcaatcatacccaatctgttttaatcgaaaaattacgtgctgaaaattatcaattgggtttattttctgctacgaatttcaaagatagcatcttccgccaagcattatttcgtgaaataaaactttcatcgaataaaaccaacaaaccaaataatgaaagtgcggtaaaaaatctcaatgattttattaaagcacaaaaaactgactcaccttggtttgcttatttggatttagccttggaggctaaaaatccatcagattatgaccgcactttgcaagacattgattctcttttagcaaaagcgttagaaagtacaccgcttgaaaatacattagtcatcatcacgtcagagcatggtttaacctttaatgaaatgaatcaaaaagagcgagaaaactactttgggcgtgatgaaattcaagtgccattgcttgtatattggaaagatttaccagtaggtaaacaaaatggattaagtaatcatgcggatattttctctgcattaatgcagacagtattccgtgtagaaaacccgttgatggattatagtcagggacgcaatctctttgatcttaaaggagatgactgggtacttgcctcgaatttccgctggaatgtggtgattcaacctgatggaacacaatatcacattgatcgcaaaggtaattacaaaaaattcgataaagattatattgagcaatcttcagacagaccgccacttggaatttttttagaagccttccaattacaaaatttcttctttgaaaaataatctataagtgcacaaaagaatggattttttgcccttaagtctttatactcacgcctcagtttaagactgaaaaatgttattaatgaaaatccgtgagtttttcataacattatcataatgcttctcgccgtacttacagtacctttcaattaatatacattctcgtctttttatcctttcttttttacggagtttgtatgaaaagccatgttcgtagttttaaaacctatattcgcgatgaaattatcaaaaaaggcgggtgggtaaatgcccatgctcatgctgaccgcgcttttacgatgacgccagagaaaattgggatttatcatagtagtaatttgcaacaaaaatgggatttagtggatgaagtaaaacgcacttccagtgttgatgattattacgcacgtttttgccaatctattgaattaatgatatcccaaggtgtaaccgcatttggtacttttgtcgatatagacccaatttgtgaagatcgtgcaattattgccgcacacaaagcccgcgaagtgtataaacatgacattattttaaaatttgccaatcaaactttaaaaggggtaatcgaacccactgcgcgtaaatggtttgatattggtgcagaaatggtagatatgattggtggcttaccatatcgtgatgaattggattatggacgtggcttagaagcgatggatatcttgttagataaggccaaatctcttggaattatgtgtcatgtacatgtagaccaattcaacaatccaagtgaaaaagaaaccgagcaactttgcgacaaaaccattgaacacggaatggaggggcgagttgtaggtatccatggtatttccattggctcacattcaaaagaatatcgctacaaactttacgaaaaaatgcgtaaagccaaaatgatgatgatagcctgtcctatggcatggattgacagtaatcgcaaagaagatcttatgccattccataatgcgctcacgccagcagatgaaatgatccccgaagtatcactgttgccctaggcacagataatatttgtgattacatggttcctctatgtgaaggcgatttatggcaagaattaagcctattagctgctggctgccgtttcccacacttagatgaaatggtcaatatcgcaagtattaacggtcgtaaagtgttaggactagagctaatttagttgcgtatggtgggtttaagccagctagttaccataactattttaaaacccagaaaaacgcgtaaaagtgaaagaattgattgcgatatttggtgctcgtaaataataaaaataaaccgcacttttgttagtgttcggttagatgactgttttctttaaatcatctagtgtattaaaattctcgaagttgccttcttcttgcgtgaattttactgaaatcccgccattttctttcataaattgtaaaaggcgtcgttcacccgatgctaaatagtgtcgcaatttttcctttagctgaacggacattaaacaaaaaacgggatgttcacgttcttcatcgcaagcatacgcaattaaagtgcggtcatttttaaccgcacttttgagtttatctaaaagattcataggaaaaaaaggcgtatcacaaggtgtaaaaaggataaagtcgctttttgtcttttctagagctgttagcatgccacttaatggcccttgaaaatcgggcagttcatcggagaaaacaggaaagccaaattttgcatattctgtttgatttcggttagcgttaattgaaatctgatgaatttgtggttgtaagcgattaataatatgttcaattaaagattgtttacctaaaatctgtaatcctttatcttgcccgcccattctacgagccttgccacctgccaaaattactgcgcttattgtaattgtcatattttaatctatcattatttcaagtatcatttgcctattttttacgattaaaaaggaaatagcaatgaaataaaaaggaaatagcaatgaaatgtaagcgtttaaatgaagttttggaacttttacagtcttattggtctaaagactcggatttgagtttaatggaaattttgcaaaaaattgccaatgaatcaggtttccaaaaaccattaaatgaattaactgatgaagtgattatttatcagttaaaaatggatggtacagataaatatgagccaattcctggtctcaaaaaagattacgaagaagattttaaaaccgcattgctccgtgctcgcggtatcattaaataagaggaaagaaatgaaaaaagtattacttgcgttaggtttaggtgtcagcacgcttatgtctgtaaatagttttgccgcagatttacaagaaggcaaacaatatgttcaagtgagtcaacaggcttcacagcaaaaagaagtgattgagtttttctcattctattgcccgcattgttacgcctttgaaatggaatacaaaattccacaacaagtcgtagatgctttaccaaaagatgtgaaatttaaacaatatcatgtaaatttcttaggtcatcaatctgaaaacttaacacgtgcttgggcgttagcaatggcattaggtgcagaaagtaaagtaaaatcaccattatttgaagcggctcaaaaggatgccttgaaatcaatggatgatattcgagctatcttcttatcgaatggcataaccgccgagcaatttgatggtggcattaatagttttgcagtaaatggtttagttaataaacaagtgaatgcagcagaacaatttaaagtgcgtggcgtacctgatttttatgtaaatggaaaattccgtgtaaaccctgaagggttaaattatgatgatttcgtgaaagattatgtgcaaaccgtaaaaggtttattgcaaaaataacgaaaaattggtttaatgccagccctattttgtaaatattaatgaaagaagagagaatattatggctgcaagttttagcgtaacgcgtcgtttctttgacgacaaaaactacccacgtggtttttcccgtcacggtgattacacaattaaagaatcacaggtgcttgagcaatatggtcaagcgttcaaagcattagacttaggggaacgtgagccagcgactaaagaagaaaaagatttcgtcgcattttgccgtggtgagcgcgcagcagagactttctttgaaaaaacttggaataaatatcgtactcgtattaacactaaaaaacgtgtttacaccttatctagtgatgtgagtgaagctgcctctggcggtgaagattattccggcgaataagatacgttaaataaggcaggcggaagtctgccttttgtttttgaatagcttgtgaaatcacgcgtaattcacggctgataactttattctcctatctttgtatgaacgattcgtcttcatacaccctatgaatactaatttctatgcaattaccgatttctcaatacaacgaactgctacaaaaaaaacttgaaaaattaaccgcacttttacacccttttaatgcaccagatattcaagtttttgactctccaacaagtcattatcgcatgcgtgcggagtttcgtatttggcacgagcaagatgatttttaccatattatgtttgatcaagcgacgctgcagcgttatcgcgtggatgaatttccaatcgccagcatgctaattaatcgtatgatgcaaaccttattacctttgttaaaacaacaagaagtgctacacaaaaaattattccaaattgattaccttagcaccttgagtaataagattattgtgagcttgctttatcataaaacactcactgaagaatgggaaagtgcggctaaaaatttgaaagatttactcgaaaagcaagattttgatgtgcaaataatcgggcgtgcaagtaaacaaaaaatctgttttgagcaagattatgtggacgaagttttacctgtgaatggcagaaattatgtctatcgccaagtcgagaatagttttacccagccaaacgcaacggtaaactgcaaaatgcttgaatgggcaattgattgtacccaaaatagcgaaggtgatttattagagctttactgcggaaacggtaatttttctatcgcacttgcacaaaatttccgtaaggtattggcaacagaaatcgccaaaccttccgtagccgccgcacaatttaatattgctgaaaataaagtggataatttacaaattatccgtatgtcggcagaggaatttacgcaggcaatgaatggggttagagcctttaaccgcttgaaagggattgatttaaaatcttatgaatgtaataccatttttgtcgatccgcctcgtgcggggcttgatcctgatacagtgaaacttgtacaaaattacgatcgcattttgtatatttcctgtaatccacatacgctgtgtgataatcttgttgaactatcaaaaacgcaccgcattgaaaaagcggcgttatttgaccaattcccttatactgaccacatggaaagcggcctatggctcattcgcaagtaggaattcagctgatttctgaatcgacagaaaaaacattagcagaattgatcgcactttgtgctgaacacaacattattcataatgaaaagagcccacttgcacttgttcaaaccgatgaccgtttagaacttcgtaaactagacgaacctaaactcggagcggtttatgttgattttgttggtggcacaatggctcaccgtcgtaaattcggtggtggacgtggagaagccgtagcgaaagcagtagggattaaaggttcggcattgccaacggttattgatgcaacagctggtctaggacgtgatgcctttgtgttagccgcaattggctgccaagttcgtttagtagaacgccatcctgttgtttttttacttctgcaagatggtttaaatcgtgcttatcaagatgaggaaatcggcgagatgttgcaacaaaatttgcacttgctgaatgttcagcatattaatgaacttgatcctaatagcgattatgccgatgtggtttatctcgatccaatgtatccgcataaacaaaaatctgcactagtaaaaaaggaaatgcgtgtattccagcatttagtcggggctgatttagatgctgatgaattgcttttacctgcactccaattagctaaaaaacgtgtggtcgtgaagcgtcctgactatgcggaatttctttgtggaaaacaaccgcactttagccatgaaacgaaaaatcatcgctttgatatttatatgggagcatcccaatgctaagagaaagtgccgttgttattagctatgaaaatggcattgccaaagtgaaatgccaatcccaaagtgcctgtggccaatgcgcagctaaaaacagttgtggaacatcaagcctttccgaattaaacggtaaacgtggcgagcatatttttaatgtggaaacattaatgccattacgcgaaggtcaaattgttgaaattggattagaagaaaagtcgatgttgttgtcggcattattgatgtatgttgtaccgcttttgaccttattgattgtgactatgttgtccgattacataagcgataatgaaattctgcgtgccattttaatctttggattaaccgcactttctttcattttggtaaaatcttatagcagaaaattagggcaacaaacagaatttcagcctgttttattgcgtgtattatcttgagttttttactcgctttttattattactgcgatttagatcgcaaactataaagctagttatttaaattacccattgaaaaaagctctttagaggcttggtcaaaacttagtgatgatgtggcaaaagttgctattctagcaatgcctgttatactttatggcgagcaaccgcttttcctaaaaggatgaaatattatttttttgctcattattgcttatgcttgccttgtgatggggcgtaaatttcgtcaattagtggagggaaaataatatgtggcttactatagggcttggcattgtttcgcttcttgctattggcggacttatttttgccaattatgcagcaaaacattcttaatttattaaccccgatctttcggggttttccgtatctaaagtgcggtgatttttaaggttatttttatgaacaatcagattcctttacttggaattaccggttatagcggtagtggtaaaacaacattattagaaaaacttatcccagaactgatcgctcgtcacattcgcgtttcagtgattaaacatagccatcacaatatgcaagttgataaggaaggaaaagatagctggcgtatgaaagaggcgggttcttctcaagtcattttagcgaatgatgaacgctgggcgattatgacggaaacgccaaaacctgtttcattggattatttagcgcaacaatttgaccgcactttaacggatttagtgttggtagaggggtttaaacaagagccaattccaaagattttgctccatcgtcaagaaatgacaaaacctttacccgaaattgacgaatatgtgctcgcagttgcaactaattatccccttgaaattgaccgcactttgttggatattaaccgcattccgcaaattgccgattttattgaaaattggttgcaccattttcacggagcacgatgactactgaatccaatgcctatcgcggtttagcttgggtagcagcaatggcactttttatgcaaagcctcgatgcgaccattctaaatacagctttacccgcgatatcttccgatttacataaacccgcctttgaaatgcaaatggcgattattgcttattctttagctgttgcattatttattcctcttaccgcttgggctgcggcaaaatttgggacattaaccgtttttcgtagtgcagttttcacgtttattttaggttcagttgcttgtgccgcggcctctaatttagagagccttattttagcccgagtgattcaggggataggcggtgcctttatgatgccggtggcgcgtttagctattattcaagctgtccccaaacaacaattagtgaatgcttggaatttaatggcaactgcaggtttgattgggccaattctagggcctattttaggtggatggttagtcattcacgccagttggcactggatttttttaattaatattccaattggtgcgctaggaattttggcatcgggcagcgtgatgaacaatatcaagggcaaggcagaaaaattagattggacaggttttttactctttgcattggggttagttggtattacgcttggtttggatttactcggcgaaagtcagcataattcaagtgtaacttatagcatattagttgttggtattctgttactcgtaacttattgtggctatgctaaaaacaatgaaaatgccattttacctttatcccttttccgaactcgtacattcagattaggtattattgccaatatttttatccgattatctgcatctggtgtgccctttttattgcctttgatgttccaattatctttcggttacagtgctgaaatgtctggctggctattagcaccgattgcgttaatttctgtgatgttgaaaatattaattggacgaattttaaatcgttggggttataaaaccacgttaatttcatccgcacttttgatggcaggttctgtgatttcaatggcttggttagataaacaaagctctctaacttggattatttgtaatcttatgtggtatggggcttgtatgtcgatcatttttacttcaattaatacgctggctgtaggcgatctttcaaaacaacagtctggcacaggctctaccgtattaagtattgtacagcaagttgggattggatttggtattgctgtgtcatcaataatcttaaatctttatcgacatttctttagcgcaagtgattgcttaccacaggcattcagctatacttttttaacttcatcactttttgtaatcgcccttgtttggtcgcttatgaaattacataaacatgatggcgatcatttacgaaaaatgccttagattaatttgttataatccatagaatttttttatttaaaaaaagggaaatttgcttatatcttattgatatttcttgttggtggagatagctccatcgtttaaccataaatggtagggcattccctgcctaacattgaggtatgcttatgaaactaaaagcaacattaactctcgccgctgcaactcttgttttggcagcttgtgatcaatctagctcggcaaataaatctaccgctcaaactgaagcaaaatcctcgtcaaataatactttcgtttattgcacagcgaaagctccattgggatttagccctgcgttaataattgaaggtacttcttataatgcaagctcacaacaagtgtataaccgcttagttgaatttaaaaaaggctcaacggatattgaaccagctttagctgaaagttgggaaattagcgatgatggtttaagttatacttttcatttaagaaagggtgttaaattccatacaacaaaagaatttaccccgacacgtgattttaatgcagatgatgttgtattttcattccagcgtcagttagatccaaatcatccatatcacaatgtatctaaggggacttatccatattttaaagcaatgaaattccctgaattgttgaaatcagtggagaaagtagacgataacacaattcgtattaccttaaacaagacagatgcgactttcttggctagtcttggtatggattttatttctatttattctgcagaatatgctgattcaatgctgaaagcgggtaaaccagaaacacttgatagtcgcccagtggggacaggcccttttgtttttgtggattataaaacagatcaagccatacaatatgttgcgcatgaaaattattggaaaggtagaacacctttagatcgtttagtcattagcattgtgcctgatgcaacaacacgttatgcaaaattacaggcgggtacttgcgatttaattttattcccaaatgtagcggatttagccaaaatgaaaaccgatccaaaagtacaacttttggaacaaaaaggtttgaacgtagcgtatatcgcattcaataccgaaaaagcaccgtttgataatgtcaaagtgcgccaagcgttgaattacgcagtggataaaaaagcgattattgaagcggtttatcaaggcgcaggaacatcagctaaaaacccacttcctccaacaatttggagttataatgatgaaatccaagattatccgtacgatccagaaaaagcaaaacaacttttagcagaagcgggttatccaaatggttttgaaactgatttctggattcaacctgttattcgtgcttctaatccaaatccaaaacgtatggctgaattaattatggcggattgggcgaaaattggtgtaaaaactaacccagtgacttatgaatgggctgattatagaaaacgagcaaaagagggagaattaactgcgggtatctttggttggtctggcgacaatggcgatcctgataatttcttatccccattattaggtagctcaaatataggtaattctaatatggcacgtttcaataattcagaatttgatgctttactcaatgaggctattggattaaccaataaggaagaacgtgcgaaactttataaacaagctcaagttattgtccataatcaagcaccttggattccagttgcccactctgttggttttgcaccacttagtcctcgtgtaaaaggttatgtacaaagcccatttggctatgacgctttttatggtgtgagtgttgatggtaaataattcatattgatttacttattttaagcccttatttataagggctttttatttatcaaggattattctgtaaaaaatatgttaaataactttaacttgagtataatgctcagcattatttctatcgaatatgattccgtagaataataaaaattaattgttaatataaggaacaaaaatggatttcaatcgaattatcactcatatgaatgatcatcatcaagatgatatggctgtcctttgtaaaaaatttggcggcgaaaaggaaatcacagatgtgacgttagttaatgtagattttgctggtttagattttaaatataatggtggcaaaacattacgtgtggaatttccacaacaagctgacgcaggttcaattaaacaagtaatcatcaatctttgtgtagaaaataaaccagttgcaaattacgatcgtatcaaggctaaaattgatgaatttcgtcaagagtttaaaagctgtgtgctttctactttagataaagatggcttaccgatggcgtcttatgcaccaattattttctttgatggaaaatattatatttatatcagtgccattgcagagcattatgagaatttaaaacgcaatccaaatcaagtagaagtgatgtttttagaagatgaaaacaaagcgaagtcaattattgtgcgtactcgcttacgttataaagcaagtgcacgttttattcctcgtgaagatccaattgttgaaaaagtcttagataaattagccgaaactatgaatgatgtaggcggaattaaaacaattcgtgaatttactgattttgatttagttgaacttacatttggaacaggccgttttgtaagaggttttggccaagcttatttgattgatgctaatggggaaatttctcatattggtgtcaaaggcaatccacacgaaaaagaaagtgataaataatattgtctcttaatgaagataaagggttgagtgtaaatttatactcaccccttttgtttacgataagttcgagtgaaattgaaatttctttatttttttaccgcactttattttcattaaggacaaggcttgcttactataatttcgataacctgtctgtcgatatgctgcatactttttgatgcaatagaacagagattatcaatagttcgatcaagatcgtgttcgacaataccttcattgccgcagcaataggcaatccaaccatgccagttccaggcacagcaacgcccaatccatttttcatcagattaggcgaaacttttgcttcaatgcgttcaggtgttttgcctaaatatttcgcagctgtagcagatgcgagcgcaagagaaatgggttcggtacagcctagggctggcataacatcgtgtttaacgatgtggagtaatggtttttcaatttcgttaagtctttctaaattcattattacctatccaattaatgcgcttcatcccaattttgtccaacacctacttccacaatcaatgggacaactaattcagcagcggcttccatgtgttgtttaatttgctcacggaaaaacgcgactttttctgaccgcacttcaaacactaattcatcatgtacttgcataatcatttcaatatctggatcgtgacggattacttcatcaagtttaatcatcgctcgtttaataatatccgcagccgtgccttgcatcggtgcattgattgccacacgttctgctcctttacgacgcattgcattgctagaattaatatctggtaaatataaacggcgaccaaatagcgtttccacatagccttgtgctttcgctttttcacgaatatcagtcataaattgttgtacgctaggatagcgttggaaatataaatccatatatttttgtgcatcagcacgggaaataccaagttggcgtgaaagtccaaaggcggacattccataaattaagccgaaattaatcgctttagcattgcgacgttgctcgctggtgacttcatctaatgatacaccgaaaatttcagctgcggtggagcgatgaatatccttgccttgcgagaacgcattaattaagccttgatcgcctgaaagatgcgccataatgcgtaactcaatttgagaatagtcagcggcgacaatagaataaccttcacgcgcgataaatgcttgtcgaatatgacgaccttcttcattccgaattggaatattttgtaggtttggatcacttgatgataaacgccctgtcgccgtcaccgcttgatgataagaggtatgcactcggcctgtttgtgaattgaccatttgaggcagtttatccgtgtaagtggatttaagtttgctcaacccacgatgtttaaccaaaattttgggtaattcgtggctataggataattcttccaatacttcttcattcgttgatggcgcaccttttggcgttttttgtaaaacaggtagctcaagtttatcgaacaaaatttcttgtaattgtttggtggaggctaaattgaatggctgacccgctaatgcgtaagcttgtttttcaagtgcggttaatcttgaggcaatttcgttagattgcataaagagagcatcactatcaatcaaaacgcctgtacgttccatacgagaaagcacatgaagcaatggtaattccattgttttatacaattcaacaagcgttggttcttcttgcagtttcaaccacagtgcttgttgtaatttcattgtcacatcagcatcttctgccgcgtattctgtggcttgttctaatggaatttgattaaacgtaagctgacttttcccttttcctgcaaggctttcaaatgcgatagtttcatgacctaaataacgtttggctaaatcgtccatattatgacgacccgtactatttagcgtataggaaagcaacatcgtatcaaattcaacaccttgtaattcaatgccatgacgggcaaaaatactttcatcaaatttaatgttttgtccaattttgtgaatattaggattttctaagattggtttgatagcggcaagtgcggtcgatttttcgagtgtttttggtgcatccaaataatccaattgcaatggtaaataagcagcttcgccattttcaagagcaaaagagatacccactaaattcgcagacatataatcaaggctgtctgtttcagtatcgactgcaatgagttttgctgcattgagcttttcaatccagcgggttaaatccgcttgagtgagcaaggtttcatattttgtacgatcgatttgaattttaggcgtattttccaccgcactttgatcttgtgaggtcgctttatactggttcattttcactggctgttcagtggtttgggtaatagaatctgccccattcatcacttcattaagccagcgtttaaattcgtagcgagcaaaatattcaataagttgatccttttggctttctccaagcaacaattgatctgttgtcacgttaagttcaacatcggttttgatggttgctaatgtataagaaagatcggcattgtttttttctgccaataatttttcacctaattttttcgctccacgaattggcagttccgctactttttcaagattggcataaatttcagccatgcttcctatgccttgtagtaaaccaagtgcggttttttcgcccacgccagcaacgccaggaatgttatctgcactatcgcccatgagtgctagataatcaataatgagttcaggtggaataccgtatttttcaatcacgcccttgcgatctaataagctattattcatggtgttgatgagcataatattgtcatccaccaactgtgccatatctttatcgccagtactaatgagtacttttttacccaaacttgatgcttgtagtgcgagcgtgccgatcacatcatctgcctcaatcccttccaccactaaaagcggaatgcccaatgcacgaatcatatcgtgcaaaggctgaatttgtttgcgtaaatcatcaggcattggtggtcggtgagatttatattgttcaaacatttcatcacgaaatgttttcccttttgcatcaaaaacaacggctatatgagtgggctgtacttgtgagatgaggctttttaacatatttaacacgccgtacatcgcgcttgttggctcacctgcggcattagttaaagaaggaaaggcatgaaatgcacgatataaataagaagaaccatccactagcacaagcggatttgttgcaatttgggccataaaaatctcgttttaaactgaaaaatgtgggcattatagcgtaatttatggtgatgagcgaatggcgggtttaatgtaaaatttatgacgaatattttttgctatggcataatatcagccattcaaatatttaatttaaggaaatcaaatgtcgttaaaattggtcgaaattttagttttgggtcaggttttgcgtttaaatgtacccattgaacaagaagaattactgcgccaagctgcgcgtaatttagatatattggtttccgaaatgaaagaaaagacaggccttattcagcttgatcgtgtgctttctattgtggcactcaatttgagttttgaattaagccaagaaaaaaataaaacggctaaaattgaagaggtattgagaacgggtatccaacaattagatcattcattagaaaatattcgtgttacaaaagaaccgcattaaattaatgatcaaattagagtcattttgtcgttttataagcaactcgttaaatttgacaaataaatgctagtcaatactgagaatttgggctagtataaacccataagaattacctggagtgttcgtcagtaggctatgtccctgagccgatactttaaatcttataaattggtttcctatcgttggtgtgtaggcttaacctttgactcgttcattgggctaagaaacctgaaaacggtatcaactgatttccttgaaccgtcgggttcaaggactactgcccgcagcggcactctggggtcttccttttcatttctatgaatactcaaaaacgccagcaaatccgcactgaaatccgaaaaatacgtgcaaatttaaccgcacttcaacagcaccaagctgaacaatcggttactcaacacgcgttaaatcttatcgagcaacgacaagccaaaaatattgcattatatttttcttttgatggtgaaatttccacaaaagccttaatccaatccctgtggatgcaaaataaaaatgtgtatttgcctgttttacatccttttactaaacactatttattgtttttacgctatttacctgatacgccaatgaaacaaaatcagtttggcatttgggagccaaagctaaatgttcaaaatgttttgccattaaatgaactggatattttatttacgccattggtggcttttgataaaaaaggaaatcgccttggtatgggcggtggattttatgatcgcacgttgcagaattggcaaaataaatcttttattccagtggggttagcgtaccaatgtcagcaagtagaaaatcttcccactgagcattgggatgtgccactattcgatattttggtaggttgaaacctatcatcaaatttttattgatagataaaatcaaaatatttcattttttctcttgaaatttattcaaccgagcttacttagtttatgcaaatggcgaaagccgaaatcaaattgaggaaagtgtatgaacattgaaaaatttacgacaaaattccaagaagcgttaagcgaacgacaatcacttgctatcggaaaagacaatcaatttattgaacctgtgcatttattgaccgcacttttaaatcaacagggcggctctattgcgccaattttgacagcaagtggcgtaaatgtggctttattgcgtaatgaattaaagacagaactaaataaattgccgcaagtgattggcaatggcggtgatgtacaactttcacgccagcttattaatctacttaatttatgcgataaattcgcacagcaaaaccaagataaatttatttcgagcgaattgtttttgtttgcagctttagaagaacgaggaacgatcagcgatattttgaaaaagtgcggtgcgaaaaaagaacaaatttcgcaagctattcagcacattagagggggacaaaacgtgaacgatcaaaatgcagaagaaagcagacaagcgcttgaaaaatatacgattgatttaaccgctcgtgcagaaagtggcaaacttgatcctgtaattgggcgtgatgaagaaattcgtcgagccattcaagtattacaacgtcgtaccaaaaataaccctgtgttaattggtgaaccaggtgtagggaaaacggcgattgtcgaaggcttggcacagcgcatcgtaaacggcgaagtgccagaaggtttgaaaaataaacgtgtgctttcattagatatgggggcgttgattgctggtgcgaaatatcgtggtgaatttgaagaacgtttaaaagcagtactcaatgaactttcgaaagaagaaggtcgcgttatcctctttattgacgaaattcatactatggtcggcgcgggtaaaaccgatggtgcgatggatgcgggtaatttgttaaaaccaagtttggcacgaggcgaattacattgcgtgggtgcaactactttagatgaatatcgtcaatatatcgaaaaagatgccgcacttgaacgccgtttccaaaaagtctttgtggacgaaccaagtgtagaagataccattgcgatcttacgtggtttgaaagaacgttatgaaattcatcatcacgtggatattactgacccagcaattgtcgctgcagcaacgctttcacatcgttatatttccgatcgtcagttaccagataaagccattgatttgatcgatgaagcagcgtctagcattcgtatggaaatagattctaaacctgaaccgcttgatcgtcttgaacgtcgtattatccaattaaaattggaacaacaagcgttacaaaaagaagaagacgaagcaagtcgcaaacgtttagaaatgttagagaaagaattggctgaaaaagaacgtgaatacgccgaacttgaagaagtatggaaatctgaaaaagcaacgctttctggctctcaacatattaaacaagagttagatactgcaaaaaccgaactagaacaagctcgtcgcgcgggtgatttagcgaaaatgtctgagttgcaatatggccgcatccctgatcttgaaaagcaacttgagcaagctgaaaccagcgaaggaaaagaaatgacgcttttacgctatcgcgtcacagatgaagaaatcgcagaagtgctttctaaagccacaggcattcctgtatcaaaaatgatggaaggcgagaaagaaaaactcttgcgtatggaagatgaactacataaacgagtgattggtcaagaagaagcggttgatgcggtagcaaacgcgattcgtcgtagtcgtgcaggtctttccgatcctaatcgcccaattggttctttcttgttcctagggccaacaggtgttgggaaaacagagctttgcaaaactttggctaaattcttgtttgatagtgaagatgcgatggtgcgtattgatatgtcagagtttatggaaaaacacagtgtttctcgtttagttggtgcgcctccaggctatgtcggctatgaagaaggcggttatttaactgaagctgttcgtcgtcgtccatattcagtgatcttattagatgaagttgaaaaagcacacgcagatgtattcaatatcttattacaagtgttggatgatggtcgtttaactgatggtcaaggtcgtactgtggacttccgtaacactgtggttattatgacctctaacttgggttctgatttaatccaaggtaataaagacgaaagctatagcgaaatgaaagccttagtgatgtcagtggtaagccaacatttccgcccagaattcatcaaccgtattgacgaaaccgtggtattccatccacttggtaaagaaaatatccgtgcgattgcaagtatccaattagaacgcttagcaaaacgtatggaaactcgtggatacgaattggtgtttaccgatgctttattagacttcattggcgaagtgggatacgacccaatttatggtgcacgtccattgaaacgtgctattcaacaagaaattgaaaacagcttggcacaacaaattctatctggtgcgttattacctggtaaggttgttaccattgattatgccaacgcagaagttcaagcgagacaataggtattaaaaaagtgcggtaaatttaccgcacttttcttatgaacctaaacgctgacgtacaatttcaaataaacatacccctgttgcgacagatacatttaatgatgaaactgaaccagccattggaatgctaatcagttgatcgcaatgttcacgtgttaaacgacgcattccttcgccttcggctcccataacaagtgctagtggtcctgtcagtttgctttgataaatggtttcagttgcttcgccagcagtgccaaccacccaaatattatggttttgctgtaaatcgcgtagtgtgcgagaaagattggttacacgaattaacggcacggtttctgccgcgccacaagcaactttacgtgcaatagatgttaattgtgcggatttatctttcggtacgatcactgccactgcgcccgctgcatccgctgttcgcaaacatgctcccaaattgtgtggatctgtgacgccatccaaaactaataaaagcggattttgtttattcgcaagaatttcatcaagatcattttcattaagttcttttgccgcttgtactcgagcaatgacaccttgatgaacctcaccatcggcttttttatcaagtgtttgtcgattaacaaattgcacaccaattcccagggaataaagctcatttaagagtggctgtagacgtttatcttcacggcctttaagtacgaagacttcaattaaacgttctggtgaatgggttaaaatactattaacagcatgaatgccgtagatttgttctgacataaatttctctttttcttatttgaatttttaattcattcttacaataggaagtgaattattttcgttttctagatgttttcttcgaaacgtctttcttttttaccgcactttttcgttttttggaggctttggacggtagctctttaaaaactttcttagctttttctttcgcggtttttccagctcgacgaggcttacgttcactacctattagcgagaaatcgaccattttattttctaaatgtaccgcttcaactttgatgcgaactttatcgcctaagcgatattgcattccgctattttcgccgattaaacgctgttttgctgcatcgaattggtaataatcgttttctaaggtggaaatatggactaaaccatcgatgaataaatcatctaagcgtacaaataaaccaaatcccgtcacagatgaaataacaccgctaaattcgccaccgacatgatcttgcatatattcacatttcagccaatcagccacttcacgagttgcgtcgtcagcgcggcgttcggtcattgaacagtgattgccaagtaaatccatttcatcaaaagagtaatgataaccgcctgtatcggtggttttacgtttagcgccttgttctttagcgagtaaatatttgatacctcgatgaagtgttaagtctggataacggcgaattggcgaagtaaagtgagcatattcttccaaagccaagccaaagtgcccaatattatcagcatgatagacggcttgacttaatgaacgtagcaacattgtttgaataagttcatgatcaggccgttctttaactttttctaagagagcagcatagtcttttgtagttggttttaatccgccttctaaagttaaaccaaactcacttaagaaagtncggaacgatgttaatttttcttcgctcggggtggcatgaatgcgatataacgctggctctttatgtttttccataaaattggctgctgcgatattcgcaagawtcatacattcctcaatgattttktgggcatcattgcgaacaacgggttcaatacgctcaattctccccattgcattaaaaataaacttagtttcaatggtttcaaaatcgatcgcaccacgttgatgacgcgcactaagcaaagcttgatagagtttataaagttcttctaaatgaggcacaagcgtagaataacgagtgcgtaattcttcatcgccttcaagcatttttgctactttggtataagtgaggcgagcgtgagaattcatcactgcttcataaaagcgataatctgtgagcttacctttggcagaaatttgcatttcacacaccatacacaaacgatccacttgtgggttaagagagcataagccgttcgataaaatttcgggtagcataggtacaactcggttcggaaaatagaccgagttaccacgattatgcgcttctacatccaaagtggaacgtaaacgtacgtaataactaacatccgcaatcgccacccaaagtttccagcctttgccgtgtttttcacaataaacggcatcatcaaaatcccgcgcatcttcgccatcaatggtcacaagcggtaaattgcgtaaatccacacggcctttttttgcttcttcagagacttcttcagtgaattttttaacatatttttccaccgcacttggaaacttatggagaatatcgtggttacgcaaggcgatttctacttccattcctttcgccatattatcgcctaggatttcagtgattacgccaattggctggttaaaactggcagaacgttcttgcaattcgacaacgacaacttgtcccatacgtgcaccattacgatgttcatttggcacgagaatatctcgaccaattctgctatcatcaggcaccacatagccaaaaccgttttctaagaaaaaacgacccacaatttgttttttacggctttctaatacgcgcacaattcgcacttcacggcgaccacgacgatctaatccagcaggttgcgctaagacaaaatctccatgcatgactctttgcatttgatggttcggaatgaataaatcatcctttttgccatcgacctgtaaaaaaccaaaaccttcgcgatgaccaattaccgtgcctttaaataaatctaatttttctggtaaggcatagcgtttacgtttggtgaacactaattgtccgtcattttccatcgcgcgtaatcggcgacgcatcgcttctatttgatcttcatttcgaatggaaagtgcggtcaaaatttcatcccgattcatcggtgcattattgtctcgaataacggttaaaataaattcacggctcgggattggattgccgtatttttccaattctcgtttgtaatgcggatcttggtttattaagtttttacgtttttttgtcattattttttacagttttaaaaagtgcggagagtttgacactgtaaggaggataatgcaagacggggataaaattatcactgtatattttaaggatattttaaaattgaagaacttaacgatctttccccagcactataacagtgatgactttttatagatatttttaaagtatgaaaagcgcggtaaaaattttatgcaggaacgcgttctgttacgagcatttgtagttttcgtaaaataacatttaatactacgccataggctgggacgaacaagataattcctataaataatttaaatagataatctacaaagccgagttgtgcccagtgttcagccatgaacggatctgcactttggtagaaggcgatactgaagaaaacaaacgtatccgccattgaaccgaatgtcattgagctagttggcgccacccaccatgtttttaactggcgtaagcggttaaatacgatcacatcaagcaattgtcctacaacgtaagctgcaaaacttgcaatagcaatacggaatacaaacagatcaaaatgcgttaatgattcgaaaccttggaatttgctttcagagaataaaacagatatgacgtaacttacaataagtgcaggaaacatcactacgaagatgatttttctcgcatcttccgcaccgaaaattcgtacggttaaatcagtagctaaaaagataaatgggaatgtgagcgttccccaagtgctgtggaaagraaaatcatttgctgcaccaagtgcggtcaattttagcgtgatttcaaaagggatttgtacaaagtaattgctcgctgcaatgatgaatatgtggaaaaagctgagccagatgattgcacgacgtttttgttgatcattaaagatcggagaggttaatttcatgttgtacctttttagtttaaataaatcggggttagggaacccgaggttgaatatagggggctagatgatacgcatatttctaataattgcaagagtcgattgcatttgagttttatattttatgaaaattgacgaatgattttacagcctttattctatttgcgtttttcatcaaatttgaaaggagagaaaatggagttacacaatattcgtgatgaatatactaaacgagtgctttcacaacatgattgccatgaaaatccaatttcgcaatttgaacagtggcagaaagaggctattcatgctcaagtcaatgagccaaccgcaatgaatattgcgactgttgatgaacaaggtcgcccaaatagccgaatggttttgttaaaagaagtcaatgagcaaggttttgtcttttttaccaattatcttagtcgaaaaggcggctgtattgagcacaatccttatgtcgcgctgactttcttttggcctgaattggaacgccaagtgcggattgaaggtaaggcggttaaaattccagcagaacaatccgataaatattttgctacccgaccttacaccagtcgtataggagcttgggcaagtgagcaaagtgcagtgatttctaattataaatctttgttagcaaaagccgcattggttgccgctaaacatccgttaaacgtgccgcgcccagattattggggcggctatttagtcgtgccagaaaccgtggaattttggcaggggcgtccaagccgtttacatgatcgcattcgttatcgtaaagaaagtgataattggattagagaaagactttctccttagtaaattgagaatgaaaataaccgcactttagttgtatcccgaaagtgcggttaattttttctaaattttagcgtttagctttatttattaatgcgtgctagtacttgttgttgtacgatttgcacgtttgcgatcgttttccgttaaaagttttttacggatacgaatcgactcaggtgttacttccactagttcatcatcatcgataaattcaatcgcttgttcaagactgaattttacaggtgtagttagcacaatcgcatcgtctttacctgacgcacgcatattagttagttttttaccttgcaagcagtttacggttaagtcatttgagcggctatgaataccgataatttgaccttcataaacttctatgtttgcatcaatcattaacttaccacgttcttgtaagccaaataatgcatagccaagtgctttacctgttgcattagaaatcaacacaccatttttgcgctgaccaatttcgccgcctttgatttcatcatagtggctaaagcttgagtaaagtaagcctgtaccagaagtcatggtcataaaatcaccacggaagccaatcaatccacgactagggataatgtattccaaacgcacacgacctttaccgtcaggcaacatatcacgaacttcacctttacggatacccaatgcttccatcacagaaccttgatgttgttcttccacatcgatagttacttgttcgtatggttcttgttttttaccgtcaatatcacgataaattacttttggacgagaaaccgcaagctcataaccttcacgacgcatattttcgattaacacggaaagatgtaattcgccacgaccagatacacggaattcatctgggtttggggtttcttctacgcgtaatgccacgttgtgaaccaattctttatttaagcgttcaagaatttgacgcgatgtgacgtatttaccttcttgtcccgcaaatggagaggtatttacacagaagaacatggttacggttggttcatcaaccgttaatgatggcagtgcttcaactgtgttgatatcacaaatcgtatcagaaatatttaattctcctaaaccagtgatagcaacaatatcgccagcataagcaacgtcttcttcataacgttgtaaaccaagatgtccaagtacttgaccgatacgaccttgacgagtttttccttcactattgatgatagtaacaggttggtttggtttaatcgaaccgcgcttaatacgaccaataccaataacgcctacatagttgttgtagtctaattgtgaaatttgcatttggaatggcgcatcaagttctacttttggcggttctacatgtttcacaatggcttcaaataatggggtcatatcttccgctaaatcttcgtgttcaagaccagcaacaccatttaatgctgaagcatagataatagggaagtctaattgttcatcgcttgcaccaagattgacaaataagtcaaacacttgatccacaacccagtcaggacgtgcaccagggcgatcaactttattaattacgacgattggttttaagccgtgagcgaatgctttttgtgtaacgaaacgcgtttgtggcattgggccatcaaacgcatcaacaactaatagaacagaatccaccatagaaagtacacgttcaacttcgccaccgaagtctgcgtgccctggagtatccacgatgttaatgcggtagtcattccagttaatcgcggtattttttgcaagaatggtaatgccacgttctttttcaagatcgtttgagtccataacgcgttcatccacatcaccacgagcagattcaaaagtaccagattgttgaagaagtttatctacaagagtggttttaccatggtctacgtgcgcaataatggcgatgttacggagttttttaatatcaatttcgtttttcattgtttaatgctttaattggataagatgcaatttttattgcattgttacataaaaaatggcgcaatgaattgcaccctacatttctacatttgtcgaaaaggaaaaattatacatgtatttttctttttctgctatgactagaataagaaaaataaatttcatgaaaaaatagcatggctacgttataatgtgcgcttatcttaataagactaaccatagaggatttcctaatgccaaacgcaaatgcaattgccaatgtatttaagctaattgaagaaaataatgtgaaatttgtacttcttcgatttaccgatattaaaggtaaagaacatggtgtttctatcccagttagccttgttgatgaagatatgtttgaagacggcaagatgtttgatggttcctctgttgaaggatggaaaaccattaataaagccgatatgttgcttatgccaatggctgaaacggcaattgttgatccattcgcgcaaattccaacgctttctattcgttgtagtgtttatgaaccaacgacaatgcaaagctatgatcgcgatccgcgctctattgcaattcgtgcagaaaattatatgcgttcaacaggtattgctgatcaagctttttttggtccagagcctgaattcttcttatttgatgatgtgcgttttaatgtatcaatgaacaaagcatctttttctattgatgatatagaagctgcttggaacacgaataaaaaatatgaagaaggcaataacgcttatcgcccattgaaaaaaggtggatattgtgccgttgcaccgattgatagtgcgcacgatattcgttctgaaatgtgcttgattttagaagaaatgggattagtcattgaagcccatcatcatgaagtggcgactgcagggcaaaacgaaattgcgactaaatttaatacgctaactttaaaagcggatgaaactcaaatttataaacatgtcgtacaaaacgttgcattagagcacggtaaaacggcgtgttttatgcccaaaccaattactggagataatggttcgggtatgcactgtaatatgtcgttaagtaaagacggaaaaaatattttccaaggcgataaatatgcaggcctttctgaaaccgcactttactacatcggcggtatcattaagcacgctaaagccttaaatgcgttcactaatccaagtactaattcatataaacgtttagtgcctggttatgaagcaccagtattgttggcttactctgcaagcaatcgttcagcctcaattcgtatccctgctgtaaccaatccaaaagcgattcgcgtagaagcacgtttcccagatccattggcaaacccatatttagcatttgctgcattattaatggcaggtcttgatggcgtggtaaacaaaatccacccaggcgatgcgatggataaaaatctttacgatcttcctccagaagaattaaaagatattcctgcagtagcaagctcgttagaagaagcgttaaattcattagaaaaagactatgaattcttaactcaaggtggcgtatttgctaaagattttattgatgcgtttatcagtatcaaacgtaaagaagtggaacgtttaaatatggcaccacatccagttgaatttgaaatgtattatgcataatgatatataaacaagaacaatgcggtgaaatttcgccgtatttttttaaaggagtaaatatgactaagatttcttctcaaaagaatgactagattgatttaatggagcttttctgcgtattcatagcaatagctggcgtataggcctgtacggcaaaagagcagtggacttcaactgatattgggttgtgcctcgttcaaccgatttcggtaacttactgcctacacgtgtggaatatgccacattattggcgacagtgaattttcttctgtagcgttatcaggttcattgtatggtcaatttaggcacttccttctttctagagatttaaaacgccagttcttaaaacaatctgtatgggtgaaaattatactaaggagatgacagaagaataaagacatatttatattgaaaatgtagtctctaagtatttagttgttcacgaaattgatccgaagaaaaaagatttaactgagttggataaaatagctttaaaaattaccttttcagcagaaactccaaaatatgcacaatctgtattgacagagtatgtaaattttgtaagtcaatatagtcttaaccaaacaaaccaagagtttaaacagggatttaacctccgtttagatgagctgagatttagtaaagaacaaattgaagagaatctaacagaagaaaaaaaggttcaagttgaaaacttaacaaatgcgttagatattgctaaaaaagcgggtattaaagatttttcaagaggaaataatatctctgattctaaattagcagatggtacatatttatttatactcgctgaaaaatatttacaggcgcaactagatattgctaaaaacacacctgttgtttacccagctaattattatattacagatagacagttatttaaattaaataaattagcttcacaattggaattagttgaggatgtaaaaacgtattattatttaagctctcctgattatcctgtggttaaagataatcctaagagatcgttgattcttgctatcgggtttattatcggtattctgttacctactttctttattttattaggttcggttatacaaactaataaaaagcagtcatgaagaaaaaggctatttttatcagtacgggagcggttattatctttaaaatattaactccctgttatagctggtgtactagcaaaatttatgatgctttccgaaaatgtttgcctgcaatggataatccatattttcaagagagctgatctgaaaaggattatgaactgattaaggcgttcttagctggtgagaataaaaggaaaactaaatgcttttatgatctgtaaggaataaagaatgagcttaattaaagatagttctatttatttaatcggagagttatctgcaaaatgtgtaccttttctattactaccctatttatcgcgtaaattaggggtagaaggatttggggagctttcttactatcaaacgtttttacctttatttgtaatttttattgggctaagccaagatggcgctgttgctcgctatttttatgtgtatggtaaacgctcattaaatttagttgtgaagacaggctatgcctatacgcttagtattggtggattaggtttgcttttttgctggttaatgcaatctgaaataatgttttacttagtattaagtgcgatatttcaggtgtttctttcagttcagctcagcattagacaatgtcaaaaacaagcgattccctatacttttattcaagtttcttcaacgattacaaatgcagcacttactatattaatgcttgaattctatcaaacagatttggtagaaaaacgtattttagcaattttaataagtaatgtttttgtagctttactttcttatttaatctatagaaaaagagtaaataataaaaagttttattttttacaatataaaacagcttttttctatataatgtcttttggttttctgatgatttttcatcacggtagcttttttattaggcaattggatagaatctttatttttcatcgctttagcgaagcggaattaggtttatatgcaatgggagcgcaaattgcatttatcttatcagtttttattttagcgataaataaagcgcttgttccctatctgtttgagaaattaaaacaaggtagtgttaagttaaaagatttacatagatggtcgttactttcattattgattgtgcctattccatcacttgttaccttaattgttccggaacaatggctattgttcttcttaggcaaacattttatcggggtaaaatactacattatagtattcttactctctacgagtttaaccatcccttatttgttcttagtaaattatttgttttatcacggaaaaactaaagaaatttcgttttgctctgtattatcaacaatgatttacttgggagcattggggggattaatttttacggatgtggtttatattccttatgctagtgtattgggggcattggggattttacctgtattatataaaataacaaaaagagtagaagaaaatgaatatgccactcattagtataataatgcctgtttataatgcagaatgttaccttaatcaaggtattttatcttgcttaaatcaatcttatcaaaacattgaattaattttaattgatgatggttcaacagataaaagtattgaaataataaataacatcattgataaagataagcgggttaaacttttctttaccccaactaatcaagggcctgcagcggcaagaaatatagggttagaaaaagcacaaggtgactatattacattcttagatagtgatgattttattgcaaatgataaattagaaaaacaacttaattttatgttgcaaaatcatcttgtaatgacgcatggcaactatgctttctgtgatttggaaggaaatcagataaaattagttacgactagtaaaaaaattgattatttaaccttattacaaggtaaccaatttaaaataatgactgtacttgttgaaagagaatctattaaattacttaggtttcctaatattaaacacgaagattacgccttctttttggattgtttaaaagaagttaaacaatctatactatatagccatcaggcaagttcatttgtaagaatcggtaaagtcagcgtttcatcaaataaatttaaaagtgcaatctggacatttaatatctattttaaaagagagaaactaggtgtagtaaaatcaatttattattttatcctctatgcctataatggatttattaaatacaagaaataaaaatatgatttcattacttattattagcttcgggcgttatcaagaagtattggaaacgtttgcatgtgtcaataaatatcatggcaataaaattgaattacttttccttgataataatccagaaagagagttggaagcggatctatcttctattgtagaaaataatagtggcattttatttagctattttcatacaggtgagaatctaggtgttgctgaaggacgcaatttcttaattgaaaaagctcaaggcgatattttaattacacttgatgacgatgttgaaattgaagatattactcttttaattcagaaagtgactgattatatggcaaataatgctaaagtaggagcattagcctttaatattaaaaactattttactcgtaaagcattatcacacgagatcccacatggtaataaaaagttagatttttcacagaatttactgacttattattttattggtgctgggcatgcaataagggaaaaaagtctatcaaaaagcggggctttaccctaaggatctggggctatatggtggcgaagaaagagatttgtcatttaggattttagaatcaggttatcagatactttatgctagtgatattgtgacttaccataaggtttcaccagatggaagaatgagtaaagaaaaagaaaacttctttcgctatcgtaatcaattgatcgttttaaatcgttatatgcactagaatctatcgctatagtgcaaatttgatttggtctctattctatttgattaaaaaaagtggaaccttgaaagaggtaatagaagtttttcattatttatctttattgtctaaatgcacaatatcgagaagaactttattatatataaagaatgttaatggtagattgttttattaaatttatatggttatatatttgcttctattatttttacttatatttagtagtgccattgatgcttttggaacatcaaggaaaaataagtattttttcttttttataagttttatgccctttttctttgttgtttctcttagagatggaattggagtagattattaccaatactaggagctttttaatttatccaggccaatatatgatgttaatataggtgctttaactaaagaacccaataatatttaattgagatatctactatttgaatcgttggttaagtatttatctaatagctttaatgtttttttatttttatatgatattgttttattctattttctatatcttggaattagaagatatccatttaagtctttttagttattaatattttttgctctttttcatatttattatattagtggacacagacaggctatggcaatggttatttatcttatcttatcttatcttatcttatcttatcttatcttatcttatcttatcttatctttttcattgttctagtgctttatatctgcttccttgcttattactttcttttttgattttaagataagggatattttgattttatctctcttatccgctattttagtatattatgattttttcgggtgggtatagagtatttgtatgaaaattactctaatgttagctatatatttggtagggtttattattattttgtccaatattctggagggaaaattaataccttaaactatataaaggttttctctatatatgtaatggttttatacttttataataagattaatagaagttttgggttgatgattttattatatttttttaggagtggtggtcttgccttcaggatctctgagttgtttcttatattttctattccgctttttgctttgttaattaatgaactatctggagtaaatagagttttaatgttttttattttagtgtattatatttctatagttttcttgagaagaatatatgttcatgtggtgtttggtgtaaatacatttttaccttataaaccaatattcgatagttatctataaaaaggttttaaatgaaatttgtttctataattagtaattctaggatgttatttttatttttgttaataaccgccaagtctgatagagagagttgtttgtatatatttgacgaaaatattcgaggtgttaatataactcctacatttgtttctacaagagctaaggggttatttgatctttttataaaaaaacttagaagtagggtagctttatctttctttttactaaaaagaaaaataaagttggaagagactatagtttatggtgcagatcatttgtctcattcattgttatttctgaagaagtgttctttctttttaatagaagatggtacagaaaattaccaccaaaaaagttataagagaagttggaaaaataaactattttcaataccaaaatttggaatgtataaaaatgtaaaaaggatctatcttacaaagagagagaatgttcctgattgtataaaaagtaaagtagaatacataaatatcaaagatctttggtttaaaaagacagaagaggaaaaattagaaatcttatatctattggggatagatatgaaaaaaattcagctattgattggcgagccttttattttatttactcaacctttatctgaagattatattcttacagaaaatgaaaaanttgatttatataaaagcnttattgataagtatgatgcatcaaanttggtgataaagcctcanccaagagagangacggattattctaganttttnccaaatgttaaggtgtttgatgaaacctacccttcggaagtattggatattttggaagtgaaatttagtagagtaattactcttttttctacagcagctttttcttaccccaaagagaaagtcgatttttatggaaccaaaatacaccctaagttattagcaaagtttggaaatattgagtatgaatagattatttttttctaaaattgcgttatggttattggattttttaacatttaatatttcttttttattatccttatttgttatttcttattatcataatggttatgaaaaatatttacctatttatgaaattgatgacagaacatatattcatgctgttttagctggaatatgtgttggatggtttgctattaggctaagacattatacttatagaaaacctttttggtttgagttaaaagagatttttagaacacttattatctttgcgatttttgaacttgcaattgttgcatttcctaaattgtatttctctcgctacttatgggcgcttacatgggggattacctttctactttttccattggcgagagttttagtaaagaaatttcttataaaatcaggttggtttcttagagatacaattatgattggttctggggataatgcttttgatgtttataatgcattaagagatgaaccttatttggggtttcaggtcacgcattttatttcagtttctaatattagtaataatgtaaaggaattaaatattcctatattaaatagtatgtcttcttggacatcagtaactaaaaaaacagatcaatttattattgcattggaagatgatgaagaggtagatagaaataattggttacgttattttnccacaaatggctatcgttcagtttctgtgattcctacattgagaggcttacctttatataatacggacatgtcttttatgtttagccatgaaatcatgttattacaaatgaataataatctggctaaactatcttctcgtattttgaaacgaaccatggatattgttgttggctccttagctattattatattttccccagtgttgctttatctgtattttgcagtaaaaaaagatggtggtaatgctatttatgggcatcctagaattggtcgtaatggaaaaacatttaactgtttgaaatttagaacaatggctgtgaattctaaagaagtgctagatgaattgctaagaacagatcctgaagcaagagctgaatgggaaaaagattttaaattaaagaatgatcctagaattactaaaatcggtgcttttattcgcaaaacaagtttagatgaattacctcaattatttaatgttttaaaaggtgaaatgagtttagttgggcctcgcccaattgtaattgatgagctagagcgttatgaagaaaacgtagattattacttaatggcaagacccggtatgacagggctttggcaagtcagcggacgtaataatatcgattataatactcgcgtttattttgattcttggtatgtaaaaaattggtcactttggaatgatattgcgattttatttaaaacaatgaatgtggttttaaatcgtgatggagcttattaacgttatttcttaagtgagatttcttctatttgcattaccttaaatttattaacccaacatgatgaatattttagtcactggcggttctggcttcatcggttccgctcttattcgatatatcattaatcatactcaagatttcgttatcaatattgataagctgacctatgcagcaaatcaatcagccttgagagaggtagaaaataatcctcgttatgtctttgaaaaagttgatatctgtgatcttaacgtaatagaaaacattttcgaaaaatatcagcctgatgcggtgatgcatttggcggcagaaagtcatgtcgatcgttctatttcaggagcggctgattttgttcaaacgaatattgttggtacttatacgttattagaggtcgctaagaattattggcatactttagacgaggctaaaaaaacgacctttcgatttcaccatatttctacagatgaagtgtatggggatttatccctttctgagcctgcctttaccgaacagtctccttatcatcctagcagcccttattcagcctcaaaagccgcaagtaatcatctagtacaggcttggcatcgcacttatggtttaccagtgattatcacaaacagttcaaataactatggggcttatcagcatgctgaaaagctcatccctttaatgatttcaaatgctgtgatgggaaagcctttgccaatttatggtgatgggcagcagattcgtgattggttatttgtggaagatcatgttcaagcttcatatttagttttgacaaaaggtcgagtcggagaaaactataatattggtggaaattgtgaaaaaacaaaccttgaagtggttaaaagaatttgccaattactcgaagaacttgcgccaagtaagcctaatcacattaagtattacgaagatttaatgacttttgtaaaagaccgacctgggcatgatgtgcgatattcattggattgttctaaaattcatgcagaattaggttggcaaccgcaaataacctttgaacaaggacttcgtcagacggtaaaatggtatttgtttaatagttcatcttcttaaatagggtaaacgataagaatgtttatctatcttgtaattttttctctttttattagacaataaaacacaacatagctgaaaaataaaaaatattgcctgagttatgagccaagaatgactggcttgtgaaataaaatatatgggaaacaatatgtataattcctaaaatacaaatacattttgtttctaaattatgggtgtttaaatttttaataaagnaaaatattggagttagaataatcaggattaatgctataaatccaactaaaccacgtttcacccaagattctaaatattgattatgtaaacttccaaaatttaaagtggttttagccatttgtttagattttacttgtttatgtctaaactcatcgtatccatcactcccatggccaaagataggcgcttcctttatagcaattaaggcattttcccacatgtcaaatctggcacctaatgaggtatttctattgtttttttctaaatagctaacaatatctgattttgctgcgttatatcgtttttcaattccgaatttaggactggtaattagtgcggttaatccaatggtaataatggcgattaaagttataataagtttcttattaatgaattctttgtatagaaataaaattataccaactacaacgggtaagccaatccatccacctctagccccagataatgcactagtcatgatagcaagtataatggctacaaacccaaataatgtagatttatattgttttttgatgaagaagtgaagagtgataacaatgctgaatgtggctaaagagatcgcaatgttgcccatttgtatatgcattgtttcaggaaacggtttttcatatcctaatgcaaatttctgaaataacgcaacacatcctgtaattaatgcactagaaggaattgcgtataaaattgttttcctttttattggaaaatttttgaataaaagtagtagaggaatgaataaaagaagtcggcttggattatctatttctctaattccatctttattgataatgatagataataagaatgtgaaaaaataaaataaaaaagaaaaaatcagttttttatcttcagagctaaaagatagttttttctttaatggtatgaaataaatcaatccaattgcgcttaatattattggcgcatagttataaccctttggaatgattaaaatggttaagaaaaatagagaaactaagaggttaattgtaaacgttagatgttttnnttgaatcatacgaataaaagcatgtgtaacttaaatttagtagattctaccttaaatatttgtaaaatgcttgttattcatgatggaatgatgtgaaattaggcataaaactggtatagtttctaaatttattttgtttatatatgggggaataaatatgcaaattacactttcaaataccttagcgaatgatgcttggggaaaaaatgcgattttgagctttgactctaataaagctatgattcatttaaaaaataatggaaaaactgaccgcactttagttcaacaagctgctcgtaaattgcgtgggcaaggaatcaaagaggtggagttggtcggcgagaaatgggatttggaattttgctgggcgttttatcaaggtttttataccgcaaaacaagattacgcgattgagtttccacatttagatgatgaaccgcaagatgaattgttagcacgtattgaatgtggcgattttgtgcgtggaattattaatgaaccagcacaaagtttaacgcctgtgaaattagtagagcgagcggctgaatttatcttaaaccaagcggacatttataatgaaaaaagtgcggtaagttttaagattatttctggcgaggaacttgagcaacaaggttatcacggaatttggactgtgggtaaaggctctgcgaacttgccagccatgttgcaacttgatttcaatccaacacaggattcgaatgcgcccgtgttagcttgtttagttggtaaggggattacttttgatagtggcggctatagtatcaaaccaagtgatggtatgagtacaatgcgaactgatatgggcggggctgcattattaacgggggctttaggtttcgctatcgctcgtggattaaatcaacgcgttaagctgtatttatgttgcgcagaaaatttggtaagcaataatgcctttaagctaggcgatattattacttataaaaatggcgtgagcgcagaagtactgaatactgatgcggaaggtcgtttggtgttagctgatggattgattgaggctgataaccaaaatccaggttttattattgattgcgcgactttaactggcgcanaaaaagtggctgtaggaaacgactatcattctgtattatctatggatgatgaacttgtgaaaaatctttyccaatccgcacaagcagaaaatgaacctttctggcgtttaccatttgaagattttcatcgttcacaaattaattcatcttttgccgatattgctaatattggttcggttccagttggagctggggcaagcactgcaacggcatttttatcgtattttgtaaaaaattataaacaaaattggttgcatattgattgctccgcgacttatcgtaaatctggtagtgatttatggtctgttggggcaacaggaattggtgtgcaaactttagctaatttaatgttatcaagatcattgaagtaaggagatgtgatgacagaaagaactttttcgattattaaacctgatgtagtaaagcgtaatctaattggggcgatcttaactcgttttgagcaaaatggctttaaaatcatagcctctaaaatggtacgcttaactcgtgagcaggctgaaggcttttatgcagagcatcaaggcaaagaattttttgtgcctttagttgaatatatgatgtcttcaccgatagtggtttctgttcttgaaaaagaaaatgcagtgaaagattaccgcactttgattggtacaacgaatccagaaactgcagcagaaggtacaattcgtaaagattttgcattaagtcagcgtgaaaactcagttcacggatcagatagtatagaaagtgcaaatcgtgaaattgcttatttctttactaattctgaaatttttgagcgttaattaatagcaaaaagcacctaaaaattttaggtgcttttaaatttttaatgcttacaaaattagactttcttaaggtttatagatgaactcaattccttcatcgtcttcttcgctccaatcatcatcccaatcttcgtcatcatcaaattgatgctctgctagtcgttcttgatgataatcttcccatttgaattttacttcttcaggtgcaacttgttgtgtttcagcttcgcgaggatttgcgatgataaagtccataatatcacgacaaagtggagaaacatttttccctgttgccgctgaaatgaagtaataatcttcttcccaacctaattgttcagcaatttctctggctcgctcttcagcttcttcatcgctcatcgtatcaattttattgaatactaaccaacgtggcttttctgataatttttcactgtattggaaaagttcagattcaataatagccatattatctgctggattagagccatcaattggcgcaatatcgactaaatgaataagcactctacaacgttctagatgttttaaaaaacgaattcctaacccagcaccatctgctgcgccctcaattaatccgggaatatcagcgactacgaaactgtgtgagtcatccacttttacaacaccgagacttggtactaaggtagtaaatggataatctgcaacttttggtttggctgctgaaacggcacgaataaaagtggatttaccagcattaggtaaaccgagcattcccacatcagcaagtagcattaattccaataataaatcgcgtttttcgcccggcgtacccattgttttttgacgcggtgcacggtttactgatgatttgaaacgagtattccctaaaccgtgataaccacctttggctaccaacattttttgaccatgttgggttaaatcccccaaggtttctttggtgtcgttatcaatagcacgagttcccacgggaacaggtaaaataatatctttaccgcgacgtcctgtacaatctgaactccgtccattctctccacgctctgcggcaaagcgtttattaaagcgataatcgattaaggtattgaggttttcatcggcttgtaaatagacatcgccaccatcgccaccgtcgccaccatcagggccgcctttcggaataaatttctctcgacggaaacttacgcaaccgttaccaccatccccagcctcaattcgaataagggattcatcaataaatttcattaaaacttctccaaaataaaccgcactttaatgatttttatgcggtaataatttatgtccaattgcggataaaattgctccgcatactacaacaaatgcgccaatatagctaatattattcaattccggtgccgcaaaatctgctgggctaaaataatgcgcaatatgagaaaataggatcgtgaaaagaggtacaagtgtgataacaacactgacttttgatacatcccaacgattaagtgcttccgcataagagccgtatccaattaaggtatttaaacagcagtaaataaaacaaatcagagctaaaggtgtgagttcttgtacttgcgagaagtcagccatcggcataaaggctatggcacaacctaaatacatcattagcaagatttgttgtgaattaaatttacgtaacattaatttttgcgccattccataagcgacccaaataagagcaccccctacacctaaaatgacacctgttgaatactgatttagtccaggcaaatgcatcaaaacgatcattaaagnataagcctaaaccaattaataataagaaaagtccgatcttttggtgcaaccctaatttttctttgaaaatcagtacaccacagatgagcattccaaaagaggataaatgaataaaaatttgtgcaactgacggttcaatgtaattcagcgagctactaaataatagaaaattgctggtaagaccaattactccaataagcataatccacgcatattggcggactttcattaattcaggtaattgttttttataagcaagtaaagccaataatgaaactgcagcaataatgaaacgataccatacgatagtttgcgcattcattacagacaaaacttgtttcaaggcaataggcaatgacccccaagccatagcggtaataagcgcaaaggtaaagcctaataaaggttgttgtttcattgtttgctcgcttatgtgaaattaaaaaagacaaaacgccccanaaaattgtagggcgtttcaatggaatagattttaaattattcagtaacaataactacgtatttacggcttttctcgccttttacttcaaatttaactttaccatctgcggttgcgaataaggtgtgatctcttcccattcctacgttgttacctgcgtggaatttagtaccacgttggcgaacgataatgctacctgctaatacagattcgccaccgaaacgtttaacaccaaggcgtttagcttcagaatcgcgaccgttacgagttgaaccaccagcttttttagttgccatctacttgatctcctctgaaattatgcttgaatcccagtgattttcacttctgtgaaccactgacgatgaccttgttgtttacggctgtgtttgcgacgacggaatttaacgattttaactttctcgccacgaccttgtgcaacaacttcagccactacttttgcaccagcaactactggcgcaccaattttaacatcttcaccattaacgaccatcaacanagaatcgaactcaactgttgcgccagttgcaagttcaagtttttctaaacgaacaacttgaccttcgctcacacggtgttgtttaccgccactttggaaaactgcgtacataaatactccgcttaattgtgttttcctgctttttagcagtccacacttaaaaattcatataaataggtcgcaaattctacggaaaaatcctacctatggcaagattttatttataataaaataaaaaanttcccttcatttgcggattgatttcagaaagtctgaaaattcgggtaaaatgcaccgcacttttaactgataaatgatgaaaaatgaagaaacaagatcttatgagcatagacgagatccagaaacttgcagatccagatatgcaaaaagttaatcaaaatattcttgctcagcttaattcagatgtaccgctaataggacagttaggtttttatattgttcaaggtggtggtaagcggatccgtccgttgatcgcagttctcgcagcacgatctttagggtttgaaggatctaattcaattacttgtgctacttttgttgaatttattcataccgcttctttgttacacgatgatgtcgtagatgaatctgatatgcgtcgtgggcgtgctacggcgaatgctgaatttggtaatgcagcgagtgtgttggtaggcgattttatttatacgcgtgcatttcaattagttgcacagttagaatcattgaaaattttaagtattatggctgatgcgactaatgttttagcggaaggcgaagttcagcagttaatgaatgttaatgatcctgaaacgagcgaasstaattatatgcgtgtaatttatagcaaaactgcccgtttgtttgaagtggctggtcaggctgcggcaattgtcgccggtggaacagaagctcaagaaaaggctttacaagattatgggcgttatcttggcactgcatttcagctcgtggatgatgtattggattatagtgcaaatacgcaagctctaggtaaaaatgtaggcgatgatttagctgaaggaaaaccaacccttcctctactacacgctatgcgtcatggaaatgctcaacaggcagctttaattcgcgaagcgattgagcaaggtggtaaacgtgaagcaattgatgaagtattagctattatgactgagcataagtctttagattatgcaatgaatcgtgcaaaagaagaggctcaaaaagcagtggatgcaatcgaaattttgccagaaagtgaatataaacaagcgttgatttcattggcatatttgtctgtagatagaaattattagtccataatttagcttatatacttgatacccattaattttaattaaactttatgaatacagaacttcaacctaaactagaaaaaagtgcggtcaattttcaagctaaaccgcgaaaacaaaaaatccgtaaggatcctaacgcaccttttattcgtgaaaaacttgagttgccagatggacacaataagctccttttgcattcttgttgtgcgccttgctctggcgaagtgatggaagcaattcttgcatcaggcattgaatttacaatttatttttataatccaaacattcatccactcaaagaatatttgattcgtaaagaagaaaatatccgttttgcaaaaaaatttggtattccatttattgatgctgattacgatcgtcaaaattggtttgatcgtgctaagggtatggaatgggagcctgaaagaggtattcgctgcacaatgtgttttgatatgcgttttgaaaaagctgctgaatatgctcataaacatggtttccctgtatttactagttgcctaggtatttctcgctggaaggatatgaatcaaatcaatggctgtgggcatcgtgctgcggaaaaatatgatgatgttatttattgggattataactggcgcaaggaaggtggctcgcaacgcatgattgaaattagtaagcgtgagcggttttatcaacaggaatattgcggttgtgtgtattctttacgtgatagtaataaatggcgagaagagacgggtcgtcaaaaaattgaaatcggaaaattatattatagtgctgattaaaaatagaaaaataaaggtgttgtttcacagaatttgctgaacagcaccttttatttcactattttatcacttcatcttgatcataatgattaatttttaaacgttgaaaataatcttttgtttcttcaatgatcacttttcgcaatccaataagcgcgataagatttgggaaagccatcaaaccatttacaatatcggcgataatccatattaaatttaagtgtaagaatgcccctaaaccaaccaacataatataagctagacgatatagttttacgccacgaataccgacgagataaacaaagcaacgttccccgtagtaacaccaacctaaaatagtcgtgaatgcaaaaaataataaaccaactgttacaatcgttgcgccaattgatgtgcctaaaccttgtgcaaaggcatagtttgtgacagtagcacccgctaattcaggattgttccacgctcccgttaataccaatacaatacctgtcattgtacagacgatgatggtatctaagaatgtacctgtcatggaaattaagccttgtcgaacaggttcacgagtttgtgccgctgcagctgcaattggtgcgcttcctaaaccagattcattggagaaaatgccgcgcgcaacgcctgattgaatcgctttcatcacagtaagccctacggcaccgcctaatgcagcttgtggatcaaaagcactatcaataatcaataaaatcgcatctggtactttttctatatttaaaaggataataaccagtgaagtcgtgacgtataaaatcgccataaacggcacaattaccgatgatgcggttgcaatacgttttacaccgccaagaataattaagccgactaaaagcgtcacaataattgcagtaactaaaactggaatattaaaagtatcttgcattgcatgggtaatcgcattgacctgtgggaatgtgccgatcccgaaaaaggccaccatcacaccaaataatgcaaataattttgctaaccatctgatacctagtccgcgttcaatgtaatacatcgggccgccagccataaagccatttttatcgcgaacacggtatttaacagcgagtaaacattcagcatattttgttgccattcctaacaaagcaaccagccacatccaaaaaatagcccctggcccacctgcttgtaccgcagttgcaacgcccacaatattacccgttccaattgttgcggctaatgcagtacaaagtgcagcaaaagaggaaacgtctccttttccacctttatcttttttgaacaaataacctagtgcgcgcggtaagtagcgaatttgaatgaagcctaagcgtaacgttaaatagagtcctgtaccagataataatataagtagaggtgcgccccaaataaagctatcaatagctgaaagaattgactcaattgtcattgtgattcctcgtcgtttaaatcaaaataaacacgacaagaagacgaaaagatacaatggaaaagaaagtgcggtaaaaaaataaataatttccacacttacaatagattgtcttttgcccctgtccttttgcctgagcgtttgaaaaacgattgaaaaattaaccgctcttttgcgcttcggcgtccatttctaaaatggatctctccaagggttcgtccagtaacagtccctgccatcgcacctgaaagattttacatcgtcggtgtggggtcaatttcccgctctccagctaccttcatccgaactcactttccattagatattgaaaagtgtgcgaattctaacaaaacaggaaatgaatttcaaaaaggaatttttatgtagaacaatcactttattcaatatctccacaaaaacgatagccttctccatgtatagtcataatgatatttggagtattgggatgatcttcaaaatgttttctgatacgtcgaattgtgacatctacggtacgatcctgaggttttaactctcgtccggtcatttttttcagcaattcttcgcgcgtttgcaattttcctggattttcacagaaatgtaacattgcacgaaattcactgcgaggaagtttgaattcttgtccttctggtgtaattaaactgtggctatttaggtctaatttccaaccattaaaacgatagaattctcgaccaaatgtattttctttttcttgatgcggcattgcacgatgcaatagattacgtgcgcggatagtcagttctctagggttaaaaggcttagtcaaatagtcatcggcaccaatttccaaacctaaaattttatccacttcattatctcgaccagttaaaaaaataagaggtaagcttaattcttcacggagttctcttgccaataataagccgtttttgcctggtaaattaatatccatcacaaccaaattaatattatgatttgccaatatatgatgcatttcaacaccattttctgcttcaaacacatcatatccttccgcttcaaaaatccctttaagcgtatttcgagtgacaatttcatcttcaacaacgagaatttttggagtagtcattttccatccttatacttattttggcgtatgctatcaaagctatcattctatctgtgcaacattattgtaacaataaaaaagtgcggtgattttttacctgattttcctttttgtgatctaaatcatagttttaggtattcaaatttctttgtgatagaatttcgagcatctatatttttatactcaattctatgaaaaaactctttcttttttttacgctgattttcaccgcttttgcggctaattcaggtttattcgataaaaaacaaacctttttaaaagtagatgatgcttttgctttttctgctactttatctacagataaaagccagttacaagcccattgggatattgccgatggctattatttgtatcaagataaaattagtgctgagttagtcggtaaatcaaatcctctctctttacatacccaacaagcggcggaattacatcaagatccttattttggcgaagtaaaagtttttactcactcaattgatggcatatttaggggtgcatttaataatgctgatgataaggttgaaatcacttatcaaggatgtaccgaaggtttttgctatccgcctgaaactaaagtattacgaattggggatttagtcgtttctcaaaagcaaattgtcgaaaaaacagttgaaaaaaataccgcacttttatctgaacaagatcgtttagctgatggtttattccatagtaaatgggcaatttttggtttctttgtattaggattgggactggcttttacgccttgcgtattgccaatgttaccgttgctttctgctattgttatcggtcagcaacaacgtccaaatatgatgcgagcgtttagtttagcttttctttatgttcaaggcatggctctgacttacactttgttagggcttgcagtggcagccatcggtttaccgttccaaatcgctttgcaacatccttatgtgatgatagggctttctattttatttgttgctcttgccctttcaatgtttgggttatttactattcaattgccaaatagcttacaaaataaactcaatacatggagccaaaaacaaacctcgggtgcttttggcggagcctttgcaatgggaatgattgctgggctggtggcatcgccttgtacatctgcgccactttctggtgctttactttatgtggcacaaagtggcgatttatttacaggcgcagtaaccctttatttgctcgcacttggtatgggcgtgccgctaatgttaatcacattgtttggtaataaaattttgcccaaatcaggtgagtggatgaataccgtaaaacaaacattcggctttgtgatgttggcgttacctgtatttttactttctcgtattttgcctgaagtatgggagccacgcttatgggctggattagcgacagtattttttatttggtttgcgttgcagatgtctaagaacggttttggctatgctattaaaattattagttttgcgttggctatggttactgtacaacccctgcaaaattggatttggcaaactcaaactacaacacaaagtgcggtagaaaatatgcctgtttctcaagttaaatttaagcaaattaaaaatactgaagaacttgaccgcactttagcggaaaatccgcattcaattgctatgttggatttatacgcggattggtgtgttgcttgtaaagaatttgaaaagctgacgttttcagatccacaagtgcaacagcaatttcaaaatatcttattgttacaagtgagtatgacaaagaatagcccagaaaataaagcattaatggaacgctttaatgtgatgggattgcctacgattttattttttgatcagcaaaataatgaaattaaaggaagtagagtaacgggctttatggatgctgatgctttttctaattggattgaaaagctactttagttattttttacttttggtaaaaagtatttttcaattttaattattgtttaactacccgttaaagattaatatgacgccgttttaattcatctttaaacaaaaggaaagcaaatgaacaatcttgaaaaatatcgcccgtatttcttggcatttttacgtatcgttgtcgcttatatgtttattttacacggcacggcaaaatttttggaatttccaatttctatgactggaggaaatggtgcagtaggcgatccaatgctactagtggcaggcgtaattgaaattgttggttccattttattaatcttaggtttatttacacgccaagccgcgtttattttgtcagtggaaatggcatatgcctatttctttctgcacgtagcaggaaaaggaaacctatttttcccaattgcaaatggcggcgagcttgcattactttactcacttctctttctatattttgtattttctggcgcaggtgcttgtgctttagataataagttttttaaaaagtagtttagttgtagtttcataattttatccttatttttgcccacatttatgtgggcttttttatgcctgaaatttatcgtatttttaccgcactttaagaaattatatttaatcttttctatatttaagcaaacgtttgcgttataattctcatcgcttatttttaactatttaatgaaaggaaaatacaatggcagatcgtccaattcgtcaggctttactgagtgtgtctgataaaacgggtattgtagagtttgctcaaggtttagttaaacgtggtgtaaaactactttcaacaggtggaacggcaaaacttttagcacaaaatgctttacctgtaatagaagtgtctgattacacaggtttcccagaaatgatggacggtcgagtgaaaaccttacatcccaaagtacatggcggtattcttggtcgtcgtggtacagatgatgccatcatgcagcaacatggcattgaaggcattgatatggtcgttgtgaatttatatccctttgctgccactgtggcaaaacctgattgcactttggctgatgcggtagaaaatatcgatattggggggcctacaatggtgcgttctgcagcgaaaaaccacaaagatgtagcgatcgtggttaataatcatgatttcaacgcaattctagccgaaatggatcaacatcaaaacagcctaacttttgaaactcgttttgaccttgcgattaaagcatttgaacataccgctcaatatgattctatgattgccaactatttcggtcagctagtaaaaccttatcatattgcagaggaagaagaggcgaatgcgaagtgcggtcaattcccacggactttaaaccttaacttcgtgcgtaaacaagctatgcgttacggcgaaaactcccatcaaaatgcggcattttatgttgatttaaatgtgaaagaagcgagcgtggctacagctaatcaactgcaaggtaaagccttgtcttacaataatattgccgacactgatgcagcacttgaatgcgtgaaagaatttgacgatccagcttgcgtaatcgttaaacatgccaatccatgtggtgtggcgttaggtaaggatattttagacgcttataatcgcgcttaccaaaccgatccaacgtctgcttttggcggcattattgcttttaaccgtgaattagacgaaaaaacggcgaatgaaattgtggaacgccaattcgttgaagtgattatcgcaccgaaagtttctgctgaagcgcaagaagtaatgaagcgtaagaaaaatgtgcgtttgcttgaatgtggtgaatggacttctcgttccgaacgtttggatttcaaacgtgtaaacggcggtttattagtacaagatgcggatttaggtatggttggcgtggatgatttaaaagtcgtgagtaaacgtcagccaactgaacaagaattaaaagacttattattctgctggaaagtggcaaaatttgtgaaatcgaatgccattgtttacgccaaagacaatcaaactatcggcattggtgcaggtcaaatgagccgcgtatattctgcgaagattgcgggtattaaagcgcaagatgaaggtttagaagtggctggttgtgtgatggcatctgatgcgttcttcccattccgtgacggcattgatgcggcggcgaaagtgggtattcaatgtgtgatccatccaggtggatcaatgcgcgatcaagaagtcattgatgcggcggatgaacataatatggtaatggtattgactggaatgcgacattttagacattaatttatctaactatccccctctttacaaaagagggggaattgcaggtaaaaaatagccgtactttttttaaattaggcatacgcaaggactacaacatgaacatcctcatcatcggaaacggcggtcgtgaacacgccttggcttggaaagttgcacaatctccattagcagataaagtttttgtcgcaccgggtaacgctggtactgcattggaacacaaagtagaaaacgtgaatatttctgcgacagatattccagcattagtgaaatttgctcaagataaacaaattggattaaccattgttggtcctgaagcccccttagtgattggggtagttgatgcatttcgtgaagctggattgaagatttttgggccagctaaagcggctgcgcaattggaaggttcaaaggcattcactaaagattttctcgctcgtcataaaattccaacagcggaatatcaaaacttcaccgaagtcgaacctgcattgacttacttgcgtgaaaaaggcacaccaattgtcgttaaagcggatggcttggcggcgggtaaaggcgtaatcgttgcgatgacattgcaagaagccgaagatgcagtacgcgatatgctttctggtaatgcctttggcgaagcgggcagccgagtagtgattgaagaatttctagatggcgaagaagcaagttttatcgtcatggtagatggtaaaaacgtagaacctatggcaagcagtcaagatcataaacgcgtgggcgaaaatgatacagggttaaatacaggcggtatgggcgcatattcgcctgcaccagtaataacacccgaaattcatagtcgcattatgaaggaagtgatttacccaaccgttaatggcatggcagcggaaggcaatgtttacacgggtttcctatatgcaggattaatgattatgccaaatgggcagccgaaagtgatcgaatttaactgccgttttggcgatccagaaacgcagccaataatgctacgtctcaaatcagaccttgttgaactctgtcttaaagcatgtgacggcaaattagatgaagtaatatcacaatgggatctgcgagcttctttaggtatcgtattggctgcagagggatacccaaaagattatcgcaaaggcgatgaaatcagcggattgcctaaaagtgcggtcaaaaacgagaaagttttcttagcgggtgtcgcagaacaagaaggcaagctagtcacaaacggcggtcgtgtactttgtgtgactgcgttaggcgaaagtgtatttgaagcacaacaaaaagcgttaaaattggctgagcaaattcaatggtctgggcgtttttatcgtcgagacattggttacagggctgtggaacgagagttgcaaaaataatccatatcattatgatgaattaatttcatttaagtgatgaaaatttaggaatgaaattttaattaaatttttatccataaacagttaaactatctgccataaattacataacaggagaacacaatgtttacaagaaatatgactatcgctgattacgatccagtattgtggcaagcgattcaagatgaaaatcgtcgtcaagaagaacatatcgaactcattgcatctgaaaactatgcgagtccacgtgtgatggaagcgcaaggttcacaattcactaataaatatgcggaaggctatccaggtaaacgttattacggtggttgtnagtatgctgacattgtggaacagttagcaattgaccgtgcgaaagaattatttggtgcagattacgtgaatgttcaaccgcactctggatcacaagcgaatgctgcggtgtatggtgcattgattaatgcaggcgatactattttaggtatggatttggctcacggtggtcatttaactcacggtgcaaaagtcagtttctctggcaaaatttataactccgtactttatggaattactgcggatggcttaattgattatgaagatgttcgtcaaaaagcattagaatgtaaaccaaaacttatcgttgctggtttctcggcttattcacaagttgtggattgggcgaaaatgcgtgaaatcgcagatgaagttggtgcgtatttatttgtggatatggcgcatgtagcgggattaattgcagcgggtttatatccaaatccactaccgcatgcacatgttgtgacaacaacaactcacaaaacattgggcggtccgcgtggtggtttaattctttcatcttgtggcgatgaagaaatctacaaaaaattacaatcatccgtattccctgcaaaccaagggggtccattagttcatattattgcggcaaaagcagtttgctttaaaggagcattagagcctcaatataaagaataccaagcaaatgtaatcaaaaatgcaaaagcaatggttgaagtatttaaacaacgtggttatgacgttgtgtcaaatggtactgaaaaccacttgttcttagtaagtttcatcaaacaaggattaacaggtaaagcagcagatgcggcattgggcaaagcaaatattaccgtgaataaaaatgctgtaccaaacgatccgcaaaaaccattcgtcacttctggcatccgtgtaggtacaccatctgtgactcgtcgtggtttcaatgaaaatgatgtgcgtgaattagctggctggatgtgtgatgttttagatgctttaggcaaagaaaatgaagaacaagtgattgctgaaactaaagaaaaagtattagcaatttgtaaacgtcttccagtttatccgaaatgatttattttctttcgttgattatatggttagcggcgattaatatcgccgcttattttttatgggaaattatatgacttatattgttggcttaactggtggcattggtagtggtaaaacaacgattgctaatttatttaccgatcttggcgtacctctagtggatgcggatgtggttgctagagaagtcgtcgcgaaagattcccccttattgtcaaaaattgttgaacattttggggctcaaattttaacggaacaaggcgagcttaatcgcgcggctttacgagagcgagtgtttaaccatgatgaagataaattgtggttaaataaccttctacatcccgctattcgtgaacgaatgaaacaaaaattagctgaacaaactgcgccttacacattatttgtcgtccctttattaatagaaaataaattgaccgcactttgtgatcgtattttggtggtggatgtgagtccacaaactcaacttgctcgttcagctcaacgagataacaataattttgaacaaattcaacgaattatgaattctcaagtttctcaacaagagcgtttgaaatgggcggatgatgtgattaataatgatgctgaactggcccaaaacttaccgcacttgcagcaaaaggtgctagaattgcaccagttttatttacaacaagcggaaaataaaaatgcctgacgaaatgattgaagtaccttgtccgatttgccaaaaatcggtgccttggataaatgaaagtacttttcgacctttttgtagcaaacgttgccagttaattgatcttggcgaatgggcggctgaagaaaaagcgattccaagtgatactgctgattttgcaatggatccaaatgtgagtgacgaatggagcattaaatagagattaaccgataggaaaccctatcggttaatttttataagtgcggtgctttttttgaggatttttcctaaaaatgctatgctaaacgtaattttattattctaaaatgtgatttttatgcaacaagattatttaagccaacaacgattctccgctcttcctctacacccgattgtgcgaggtgctttggcaaaaaaaggctttgatttttgtaccccaattcaggctttatccttgcctatcagtttaaatggacgagatgtcgcaggacaagctcaaactggtacaggcaagacaatggcttttttaacggctacttttcaccatcttttaactcaccaagatcctaatcttaaatatcctcacccaagagctttgattttagcacctactcgagaattagcggtacagattagtaatgacgcagaatttcttgcaaaagcgagtggattaaagaccgcacttgcctatggtggcgatggttatgataaacaactacaagcgattgagcgtggcgtcgatattttgattggtacgacggggcgagtcattgattatgtgaaacaaggcgtaattggtttagatgaaatccaagttgtcgtgctagatgaagcagatcgaatgtttgatcttgggtttatccgtgatattcgttatttattgcgtaaatgccccgctccgcaagctcgtttaacgatgttattttcagcgacgctttcttataaagtgcgtgaattagcatttgaagatatgaatgaacctgaatatattgaaattgaaccagaacaaaaaacagggcaccgaattaaagaagaacttttttatccatctaatcaggataaaatggcacttctcttaaccttaatggaagatgaatggcctgaacgctgtattgtatttgcgaatacgaaacatcgttgtgaagaaatttggggctatttggcggctgatgggcatcgtgtcggtttactgactggcgatgtagcacagaaaaaacgtttatcgttattaaaacaatttactgatggtgatttggatattttagtggcaacagatgtggctgctcgtggcttgcatatttctgatgtgacgcatgttttcaattatgatttacccgatgatcgagaagattatgttcaccgaattgggcgtactggacgagcaggggaaagtggtgtttcgattagtttcgcttgtgaagaatatgcgatgaatttaccagcaattgaagaatatattggccattctatccctgtgagccaatatgaaacagaagccttgcttgaactgccgaaaccgtatcggttgaaacgtgcggtgccaccgcaaggacatacaagacatcgttcttatcacgcaaaataggtgggcttcagtccacgcgtttatttaatgatgaaaagtgcggttaattttgactgcattttatattcctattttttatatcctactttgttcatcattcatcttgtgggtttacggcttacctacagataagtattgttacgttttttgttttttaacttgccaaaaaacaaaaaataaataaaatgaacgctcattcatttttgagcaattattgctccttattttactcaaggatcttatgcgacaagctaaaacagacttagctgaacagattttttcagcgacagatcgtttaatggcaagagaagggttgaatcaactttctatgctcaaacttgcgaaagaagcaaatgtagccgcaggaacgatttacctttattttaaaaacaaagatgaattgcttgaacaatttgcacacagagtgttttcaatgtttatggcaacacttgaaaaagattttgatgaaactaagccttttttcgaacagtatcgacaaatgtggaaaaacatttggtatttcttacaagaaaatcccactattctatccaatttaaagcaatatgaatctttgccgaatttcaaggatatttgtaaaaacattaaaaattgccgttgggatttattttgtcatcaagcacaaaaagctggcttattagcggaattatctgaagatattctctttttattaagtttgaaaacggcgataaatttagcctctgatgcaaaatttatcgatttcgatcttaagcctgaaattttagaatctgtgattgancgctcttggcgtgcgattcagaaataattgtngttatttttataacggagctttaaacatgagtcaaactcaacatcaaagaccaaaacgctcacatattttcttgatgaaaataattttagtggtatttgtcttaatttttgtcggtgtcatcggttttaatatgataaaaggcgtaatgataagccgagccattgcaggaatgccagaatcttcaagcccagtaaccgcacttgaagttcaaccgcgtgaatggacgccagttattaacacaacaggtcttgtgcgtccaaatcaaggcgcaatgctcagtacacaaaatgcgggcgcggtttcacaagtacttgttcaaaatggacaaaatgtgaaaaaaggtgaggtgcttgtggagcttgatagttctgttgaacgagctaatctacaagctgctcaggcacaattatcagcacttcgtcaaacttaccaacgttatgtgggtttattaaatagcaatgctgtatcacgtcaagaaatggataacgcaaaagcggcttatgatgctcaagtagctagtattgaatctctaaaagcagcaattgaacgtcgtaaaattgttgcgccatttgatggcaaagcaggtattgtgaaaatcaatgttggacaatatgtgaatgttggaacagaaattgtgcgtgtagaagatactagctcaatgaaagtggattttgctctttcacaaaatgatttagataaattacatatcggtcagcgcgttacagcgacaacagatgctcgcttgggcgaaacattttcagctcgaatcactgcgattgaacctgccattaattcatcaacaggtttagttgatgttcaggctacttttgatcctgaagatgggcataaattgctttcaggtatgttctctcgcttacgcattgcacttccaactgaaacaaatcaagttgtcgttccacaagtagctattagctacaatatgtatggcgaaattgcctatttacttgaaccattatctgaagaagaaaaaggaaaaatgtcaggtaatgaaaaattggatcgtctctatcgtgcgaaacagatcaccgtatttactaaagatcgtcaaggtgtttatgctcaattacagggaaatgaagttaaagtgggagataaaattattacaggcggtcagcaaggtattggtaatggaagtcttgtggaatggattaaaaaagacattgtgggtgcaatagagcctgcacataaaacaccactttaatgtatgaggaaatccgaatgaaatttaccgatatatttattcgtcgtcctgttttagcagtttcaattagtttgttaatgattattttagggttgcaagcaatctcgaaattggcagtgcgtgaataccctaaaatgactactacagtcattacagtgagtaccgcatatccaggggcagatgcgaatttaatccaagcatttgttacgtcaaaattggaagaatctatcgcgcaagccgataatattgattatatgtcttcgactagtgcgcctagtagttcgactattacaataaaaatgaaattaaataccgatcctgcaggcgcgttagcagatgtgttagccaaagtgaatgcagtaaagtcagcattaccaaatggtattgaagatcctagtgtatcctcttcttcaggtgggagcggtattatgtatatcagtttccgatctaaaaaactagattctagtcaggtaactgattacatcaatcgtgtagtcaaaccacagttttttaccattgagggtgttgccgaagtacaggtatttggtgcagctgaatatgcattacgtatttggctagatccacaaaaaatggcagctcaaaatctttctgtgccaacagtgatgtctgccctttctgcaaataatgtacaaacggctgcggggaacgataatggctattatgtgagttatcgtaataaagtagagactacaacgaaatcagtggaacaactcagcaacttaattatttcatcaaatggcgatgatttagtgcgtttgcgtgatattgcaaccgttgaattaaataaagaaaatgataattcgcgtgctacggcaaatggtgcagagtccgttgtgttagccatcaatccaacctcgacagcaaaccctttgactgtcgcagaaaaaattcgccctttatatgaaagtataaaaacacaactgccagacagtatggaaagcgatattctttatgaccgcactattgccattaatagctctattcacgaggtcataaaaactattggtgaagctactttgatcgttttagtggtaattttaatgtttatcggttcgttccgtgctattttaattccaatattggctattccaatttctcttattggcgtattaatgctgctacaaagtttcaacttttctattaatttaatgactttgcttgctttaattcttgccataggtttagttgtagatgatgctattgtggtgctggagaatattgatcgtcatattaaagcgggagaaacgccattccgagcagcaattattggtacgcgtgaaattgcagtccctgttatttctatgactatcgcattgatcgcagtttactcaccaatggctttaatggggggcattactggcacattgtttaaagagtttgctttaacccttgctggtgcagtatttatttctggtgttgtggcattaacgttatcgccaatgatgagtagtaagttactcaaatccaatgctaaaccaacatggatggaagaacgcgtagaacataccttaggtaaagtaaatcgtgtttacgaatacatgcttgatctcgttatgctcaatcgtaaatcaatgctggcttttgcggtcgtgattttctcaacgctcccatttttgtttaattcactttctagtgaattaacgccaaatgaagataaaggcgcatttattgcaattggtaacgcgccatctagcgtaaatgtggattacattcaaaatgcaatgcaaccatatatgaaaaatgtaatggaaacacccgaagtttcttttggtatgagcattgctggtgcgccaacttctaatagctcgttaaatatcatcacattgaaagattggaaagaacgttcacgtaaacaatccgcaataatgaatgaaattaatgaaaaagcaaaatcaattccagaagtgtcagtatcagcatttaacattcctgaaattgatacaggggaacaaggccctccagtctctattgtattgaaaactgcacaagattataaatctttggcaaacaccgcagagaaattcctcagtgcgatgaaagcctctggcaaatttatttatacaaatttagatttgacctatgacactgcacaaatgactatttctgtggataaagaaaaagcgggaacttacggtattacaatgcaacaaatcagtaatactttagggagtttcttatctggtgcgacagttacgcgtgtggatgtggatggacgcgcttataaagtcatttcgcaggtaaaacgagatgatcgcttatcgccagaaagtttccaaaattattatttaactgcatctaatggtcaatcagtgccattaagtagtgttattagtatgaaattagaaactcagccaacatcattaccgcgtttcagtcagttaaattcggctgaaatcagtgctgtaccaatgccgggtatatcaagtggtgatgccattgcttggcttcaacaacaggcaacagacaatttaccgcaaggctatacgtttgattttaaatctgaagcacgtcaattagtccaagaaggcaacgcattagccgtcacttttgcattggctgttatcatcatattcttggtacttgccattcagtttgaatctatacgtgacccaatggtaattatgatttctgtaccattagccgtaagtggtgcattggtgagcttaaatattttatccttctttagcatcgcaggaacaacattaaatatctactctcaagttgggttgattactctcgtgggattaatcaccaaacacggtatcttaatgtgcgaagtggcaaaagaagaacagcttaaccatggtaaaactcgaattgaggcaatcactcatgctgcaaaagtacgtttacgcccaatcctaatgacaacggcggcaatggtagctggcttaattccattactctatgcaacgggtgcaggagcggtatctcgctttagtattgggatagtgattgtagcgggattatccattggtactattttcaccttgttcgtcttgcctgtagtatatagctatgtcgcaactgaacacaaaccattaccggtttttgatgaaaataaaacaacccactaattaaaacatagaaaaaacaaaccgcacttaggttatcttacgtaattcgtacttataaatagttgttttatccaacttttttgagcataacctgcataagtgcggtatttttttattctgttaattatataaataatccacttatgttagtctttatttaaagactatttttcagtaaacttagcgaattttgttgaattattaaaattatcacttcaaatctaggaatttattgtggcacatcgagattttctgcgcgtcgtagctcaaataataagaaaaaaaataagaaaaagaatacaaatgtcttgatttttcttgctttatttattgttctagtttttgttgttggactttatttgttgaaaaatcagaacagtaaggtaagcgtgcagcaagctataacacaacaggaaaaagctcaacctaaaagtgtgttacctaatcgtccagaggaagtgtggagttatattaaagccttagaaacgcgtactgtacctgtagataataatccagcgagtgtagaacaaaatatgcgtttaacagaagaacaacgtcaagttttaattcaaatagaaagagatcaaaaagcggctgatgaagctagaaaactggctgagcaacagagaatagaagatgcaacgagaactcaatccaaaacaacggaagatatgaaaaatacagaggcagaaatcgtaaaatcggaatcaattaaaaagcaagactcacagaaaattgaaagcgcaaaaaaagtagaacaaataaaaacggttaataatgtacgggatagcaagaaatttggtttacaatgcggtgcttttaaaaatcgagcacaagctgaaaatttgcaaggtcgtttacagatgacaggattaaatgctcaaatacaaactaacggcgaatggaaccgtgttcgtgtagcaagttttgatactcgagagcttgcagtacaggcgcaaagtagagccaaaactgttaccgattgtgttgtgattggtatgtaatatatatttatttattttaatgctgagtaccaaaaggtggttttgcaaaccaaatcacaataagcaatcctaagaatcccatagcggataaccaaaatatttcatttgcgccaataataaatccttgcgatgttatttgttgagcgaggtaagctgaagtttgcgtatcacttaaaccaaattgattcatttgatggtaaaaactttgggaaattgggttataaggattaatgtgttctgttaattgagtgtggtgaacagcttcacggttataccacataaatgtggtcaaagatgttcctacagaacccgctaaagttctcaaaaagttaaataagctagaggctgaagccattttatgcgcaggcaagccagacagcgttattgtagtaagtggcataaagaaacaggacaccgctaaaccttgcactaattgtggtaaagctacatcaacaaatgtcattgatggctcgaaagttaccgctcgccaataaaatgttattgcatatacaataaagcttatcgtcactaaaattcgcatatcgatcttataaccgaaacgcccaataatcggtgaaagcaaaattgggaataatccaactggggaagctgcaagccctgcccacgtcgcagtgtaatggaagacttgttgtagcaagagcggaattaataccacagaacctagataaatcaaaaaggctaaactagtacataaacaccctacgctaaaattacgagaatggaaaagcgaaatatccactacaggattgtcatctgtcaattcccaaataaccaaggcaatcagacaaacgacagcaacaacggctaatataatgatttcattagaattaaaccaatcttgctcacgaccctgatcaagcattaattgcaaacatcccacgcctaagacaagtaaaactaaaccgactttatcaataggttgatgaacaatttcactttctctgcttcccaaaatcttccagctgattagcacaactgacaaaccgatcggaacattgataaaaaagatccatccccaatggatattatcgctaatccatccgcctaaaattgggccaaaaataggcgcaaccacaatagtcattgaccaaaatgccaatgccattccgcgtttttctggtggataattatttaataataaactttgcgaaagagggatcactgggcctgcgacagcaccttgaatgacgcgaaaaataattaacgcctcaagactatctgcaatcccacagagccaagaagagacaacaaataaaaaagttgagactaaaaataaccgcacttcgccaaaacgttttgctaaccaacccgttattggaatagaaatcgcatttgctaccccaaaagaagtaattacccacgtgccttgactaaaagatgcgccaagatcgcccgcaatagtaggaattgccacatttgcaatggtagaatctaatacctgcataaaggtggcaagagataaagccagcgttaataaaatcagcgcaccaccttgaataggcgggaatttttttgcggaattgcccataacgccgccttaatggctgttttgctgaatgatagattcaatcaaattttctaccgcactttcatcatatttaagtgtatcagtagaaaataacgttttcggttctgttttttctcgtagcattgcgcctgatgaatctgaaattcttacttttgccgttgcagaaagaccaattctcaatggcgtttctgtaaattgttgtggatctaatttaattcgcacaggtacgcgttgcaccactttaatccagttacccgtagcattttgtgaaggcaaaagagaaaatgcattgccagtccccatttcaataccatttatcacgccatcaaattctttatttttaccgtataaatcaaaatggatttttactggctgaccaatgcgcatattcgttaattgggtttctttgaagttagcttctagccacatttgttcattagataccactgccattaacgcgccacccactgaaacggcttgcccaacttgaacattacgacgcgccacatagccatcaattggacttctaatttttgtacgttgcaaatttaaccaagcctgtttaagcgagtttatcgcattctgtatttgcggttgttcacgtaatggaacgttacgcaataaagcctgattagcagccaattgatttttagaggcatttaaatttgctttggcaagctcgacagcttcttttgcgtgttggaaagattctttatcaatcgcacccattttttcaagttgaactcggcgcgccaaattgccttgagcttgagctaaagaaatttcattggcgtgcacagctgattgcaattgctgcacagtgaaacccagttgttctacctgacgtacagcattggcgagattgcttttggcctgttcgaaactaagtttcgcattggtatcatccaattcaactagaatatcacctgcatggactttatccatattgtctgcattaatcttcgctacattacctgcaacttgtgatgataccattacttgatttccacccacataagcatcttctgtttcttcaaaatccttcaagaagaaaaaccaatacaaagcacaagcaataccaataataagcaggagaagaataaaaatgcttaagccttttttacggtcagttttatttgatacagatttagttgatgggttttcagttgcaatttgcgtcataatgccttccctaagctgggataatgtttaaaaatgagatatttgagataacctttaaaactatcaaaaataaaaatgaagggtcattatgaaactttaaaaaggggaactcaagggaaatcatcatctctttattttctagattaatgaatattctaaagatatagtctcattaatttgatttattttcgtgtaagaatcaaaaatcgacaatcatagcgattttgttcatccgccttacgatattcatcaaattcaatttcccactcctcccaattcaattgagggaaaaaagtatcgccatctagttctgtttgaatttgagtaaggtataacttatctgctttgggtaaatattgtttgaataactctcccccaccaatcaacataatttcatcaaaatctctgacaaaattgaccgcactttcaaagctatctttccatatcacaccttcgtgttcaaaaagctggcgagaaagtacgatattggtacgtttaggtagtggacgaccaatactttcaaaggttttacgccccataatgacaggtttaccagtggtgttctgacgaaaccaagctaaatctgcaggcaagtgccaaggcatttggttatctttaccaatcacattatttaatgttgtcgccacaattaaactaaatgtcataaatccccctaaaatttgccgttactatacctgatattaagtgatttttcattgatttagtgataacgttaatgccaattttaagaacttggaaaggattatgaacaaaaaaacaatcgttgtgaaattcggtacaagcacgctaactcagggttcgccaaaactgaattcgccacatatgatggaaatcgttcgtcaaattgcacaactgcacaatgatggatttcgtatagtgatcgtgacttctggtgcgattgcagcgggtcgccattatttaaatcatcctcaattaccacccactatcgcctcaaagcaactgcttgcagcggttggtcagagccaattaattcaggcttgggaaaaattatttgctatttatgatatccatatcgggcaacttttattaacccgtgcagatattgaagatcgcgaacgttttttaaatgcgcgagatactttatacgcacttttagataaccacattattcctgtgattaatgaaaatgatgcggtagcgactgcggaaattaaagtaggagacaatgacaatttatcggcattagtcgctattcttgtgcaagcggaacagctttatttattgactgatcaacaaggtttatttgatagtgatccacgtaaaaatcctgaagcgaaattaattccagttgtagaacaaatcaccgatcatattcgatcaattgcaggaggaagtggtacaaatcttggtactggtggaatgatgaccaaaatcattgctgccgatgttgcgactcgctctggaattgaaaccattattgctccaggtaatcgcccaaatgtaattgcagatcttgcttatgaacaaaatattggtacaaaatttattgcacaccaatctgatcgattagaaagccgcaaacaatggcttttcgccgcaccatcggcaggtattattaccattgataacggtgcgcaaaatgccattcttgaacaaaataaatctttattacccgctggtattattaacgtggaagggcgtttttcgcgtggtgaagtagtcaaaatacgcactcaatcaggtaaagacattgcgctgggtatgccacgctataacagcgatgctctacaattaattaagggcagaaaatcagcagacattgagaatgttttaggctatgaatatggcgcagtggcaatgcatcgtgatgatatgattattttgtcataatgtcctttggttgataaaagcactgatttatgaaacaatcttgagctatttttataggaaaaatttaaggtaaaacgatagtgatcgattttgatggctaccgtccaaatgtgggtattgtgatttgtaatcgcaaagggcaagtgctttgggcgaagcgttgtgggcaaaattcgtggcagtttccgcaaggtggcattaatgataatgaaagtgccgagcaagcgatgtatcgcgaactacacgaggaagttggtttacaacctaaagatgtgcgtctgttatatgtttctaaacattggttacgctataaattgccaaagcgtttattgcgttatgacagcaagccgatgtgtattgggcagaaacaacgctggtttttgctacagcttgttagcgatgaaaaaaacatcaatatgcaaacaactaaatcgccagaatttgatgggtggcgttgggtaagtttttggtatcctgttcgtcaagttgtgtcttttaagcgagatgtttatcgaaaggtaatgaaagagtttgcttcgatactatttacggacaatccactaatattttccgcatctcgtgaagcaaattcactgcattattcggcaaacaaaaaatattctcagacaaaatacacgaaacgccatttttataaatcaagaggccaataatgttcacttttattcttctttgtttacttgttggcgcattagcgggttttcttgcaggattatttggtatcggcggtgggttagtaattgtgccaacgttagtgtatttactgcccattgtagatgtaccagaatctttgttgatgtctaccgcacttggaacatcatttgctaccattgtgattactggcattggatcggcacaacgtcatcataaattaggtaacatagtctggcaggcagttcgcattttagctccggttattatgctttctgtttttatttgtggtttattcattggaagacttgatcgtgaaatttctgccaaaatttttgcttgcttagtggtatatttagccacaaaaatggtactttcgattaaaaaagatcaagtcacaacaaaatcacttacccctctttcttccgtaattggcggtattttgattggtatggcatctagtgctgcgggaattggcggtggtggatttattgtaccgtttttaactgctcgtggcattaatatcaaacaagctatcggttcttccgcattttgtgggatgttattgggcatatcagggatgtttagttttatagtgagtggttggggaaatccattaatgcctgaatattcgctcggttacatttatcttcccgcagtgttaggtattactgccacttcattttttacttccaaattaggcgcaagtgcaaccgctaaattgcctgtttcaaccttaaaaaaaggtttcgcccttttcttaattgtggttgcgatcaatatgtttctgaaataaggaaaattatgaattcaaattatttacttcttccccactttgatccgagtatttttacgcttggcgatagtaatatcggcttacgttggtatggcttgatgtaccttttaggttttgtttttgcacgttggcttgcggttcgccgtgctaatcgcccaaatagcggttggacagtagatcaagttgatagcttacttttcaacggttttatgggggtgtttattggcggacgtgttggcgatgtatttttctataatctcgatcatttcttacaagaaccactttatttattccgcgtttgggaaggtggaatgtcgttccacggtggcttaattggtgtaattgttgctatgatttggacatcttattctcaaaaacgtaatttttggcaaacggctgattttgttgcgcctttgattccgtttggtttaggtttaggcagaattggtaatttcattaatcttgaactatggggacgcgaaacgaatgtgccttgggcaatgattttcccgaatgatcctcttttactgcctcgtcatccatcacaactttatgaagcctttttagaaggcctggtgttgtttacgattctgaatatttttattaaaaaaccacgtccaatggcttctgttgcaggtttattcttaattggttatggcgtcttccgttttattgtggaatatgtgcgtgaacctgaagttgaaaatttctttgggattattacacgagggcaagccctttgcttgccgatgattattggtggtgctttcattatggcttgggcttattcacgcaaaagtgcggtcataaaataggagatttttatgaagcaatatcttgagctttgtcgccgcattgttagtgaaggggaatgggttgctaatgaacgtacaggtaagcattgcctcacggtcattaatgcagatttagaatatgatgtggcgaataatcaatttccgctgattactacccgtaaaagttattggaaagcggcgattgctgaatttttaggttatattcgtggatatgacaatgccgctgatttccgcgcacttggcacgaaaacttgggatgctaatgcgaatgaaaatgcagcttggcttgcaaatccgcatcgtagaggcgttgatgatatggggcgcgtatatggtgtgcaaggcagagcatggcgtaagcctaatggagaaactatcgatcagctacgtaaaattgttaataacttaacgaaaggtattgatgatagaggagagattttaactttttttaaccctggggaatttgatcttggttgtcttcgtccttgtatgcatacgcatactttttctcttgtgggcgatactttacatcttactagctatcagcgttcctgtgatgttccgcttggattgaatttcaatcaaattcaggtgtttaccttcttagcacttatggctcagatcacgggcaaaaaagccggcaaggcatatcataaaattgtgaatgcgcatatttatgaagatcagcttgagttaatgcgtgacgtacaacttaaacgcgagcctttcccattaccaaaattagaaattaatccagatataaaaacgcttgaagatttggaaacttgggtcacgatggatgattttaaagtcgttggctatcaatcccacgaaccaattaaatatcctttttccgtctaatggatgcagcaaaagtgcggtcagaatttgacgagaaaatgatgcgctacgcccttgagcttgccgataaagcggaagcgttaggtgagattcctgtgggggcggtgctggtggatgacgctagaaatattattggagaaggttggaatctctccattgttcaaagtgatcctactgcacatgctgaaattatcgctttgcgtaatggtgcgaaaaatattcaaaattatcgcctactgaatagcacgctttatgtgacattagagccttgcacaatgtgcgcaggggcaattttgcatagccgtattaaacgtcttgtgttcggtgcatctgattataaaactggcgcgattggatcacgttttcatttttttgatgattacaagatgaatcatactttagaggttacatctggcgtattggcagaagagtgtagtcaaaaattgagtacattttttcagaaaagacgcgaggagaaaaaaatagagaaagcattattaaaaagtctgagtgataagtaattctttattttttcttatatttgaaacttaaaatccaggattgatcgttatctcaaatcctgttacttgcggaaactcttcttgaatgagtttcaacaattctgtctgtctgaataaaattccttggcgaacgatcgcatttgctgtctcaataaaaattgagttatctgtcatattaccaatacgaaatttgccgtgaaattcctgtggaaaaatgcggttaaatttttgattgatttcattgatagcaagaccttttttgattattttggcaaagggcgattgctcaagcacatccgtaatattgactgctttttgataacgctcagccttgttttccataaagtctgcccccagtaaatgacattagtttagatttccgttacaatacacgcaattttcataataaacaacgagacgaatgatttcaggcactgtcaaaccgaatttttggtcgcgattacttttaagtatcatcgcaatttttgctttgcctaacgcacaaagttttgaaaatcaaaataatacggaaaattattcctcaagtgtttccattcaacaagcgttagaaacggtaaaagttgctcgtgaagtgcaacgacaagccattcctcaaccttcaatttcccgtcaaactgaaaaacaacttaaaattcaaccgcacttttttactgaagcgttgaatattagcgcgccaattcgagcaggccccttgcttatttaatttttctgttttttgtgaagaatattgctattgaaatagcgatattttaaaaaattattgtgcatgaaataaagtatttcataagcatttaactatttaacttatatatttaaaaagagaaattatgagcattttaacaagaatttttggtagtcgtaatgaacgcgttttacgtaaattaaaaaaacaagtcgtaaaaattaataaaatggagcctgcttttgaggcattaagtgatgatgaattaaaagcaaaaacacaagagtttcgtgatcgtttaagtggtggcgaaactttgcaacaaattttaccagaagcattcgcaacggtacgcgaagcaagtaagcgtgtgcttggtatgcgccattttgatgttcagcttatcggtgggatggtattgactaaccgctgtatcgcagaaatgcgtactggtgaaggtaaaacattaacggcgactttgccttgttatttaatcgcacttgaaggtaaaggcgttcacgtggtaaccgtgaatgattatcttgctcgccgagatgcagaaacaaaccgtccgttatttgaatttttaggcatgagtgtaggcgtcaatattcctggtttatcgccagaagaaaaacgtgcagcttatgcggcagatattacttatgcaaccaatagtgaacttggttttgattatttacgtgacaacttagcccactcaaaagaagagcgtttccaacgtactttaggctatgcgttggtggatgaagtggattctatcttaatcgatgaagcgcgtacgccattgattatttctggtcaggcagaaaacagttcagagctttatattgcggtaaataaattgatcccaagtttaattaaacaagaaaaagaagatacggaagaatatcaaggagagggcgatttcactttagatttgaaatctaaacaagcgcatttaaccgaacgtggtcaagaaaaagtagaagattggttaattgcacaaggtttaatgcctgagggggactctttgtattctcctagtcgaattgtattgcttcatcacgttatggctgcattgcgtgcgcacacattgtttgaaaaagatgtcgattacattgtgaaggacggtgaaatcgtgattgttgatgaacacactggtcgtacaatggcggggcgtcgttggtcagatggtttgcaccaagccattgaggcaaaagaaggggtggatgttaagagcgaaaaccaaactgttgcatcaatttcttaccaaaactacttccgtttatatgaacgtcttgcgggtatgacggggactgcggataccgaagcatttgagttccaacaaatttatggcttggaaactgttgtaattccaacaaatcgtccaatgattcgtgatgatcgcactgatgtgatgtttgaaaatgaacaatataaatttaatgcgattattgaagacattaaagattgtgtagaacgccagcaaccagtattagtggggacgatttcagtcgaaaaatcagaagaattatctaaagcgttagataaagcaggtataaaacacaatgtgttgaatgcgaaattccaccaacaagaagcggaaatcgtggcagaagcaggatttcctagcgcagtgactatcgcaacgaatatggcgggtcgaggtacggatattattcttggcggtaactggaaagcgcaggctgccaaattagaaaatccaactcaagaacaaattgaagcccttaaagcagagtgggagaaaaaccacgaaattgtaatgaaagcgggtgggttgcatattatcggtacagagcgtcacgaatctcgccgtattgataaccagttgcgcggtcgttctgggcgtcaaggtgaccccggttcttctcgtttctatctttctttggaagatggtttaatgcgcatttatttgaatgagggtaagctcaatttaatgcgtaaagcgttcacggtagcaggcgaggcaatggagtcgaaaatgttggcgaaagtgattgcatctgctcaagcaaaagttgaggcgttccattttgatggccgtaaaaacctacttgaatatgatgatgtggcaaatgaccaacgtcacgcgatttatgagcaacgcaatcatttgcttgataatgatgatatttctgaaactatcaacgctattcgccacgatgtgtttaatggtgtgattgatcaatatattccaccacaatctttggaagaacaatgggatattaaagggcttgaagaacgtttatctcaagagtttggtatggaattaccgatttctaattggttggaagaagataataatcttcacgaagaaagtttgcgcgaacgcattgtggaaattgcagaaaaggaatacaaagaaaaagaggctttggttggcgaagacgctatgcgccattttgaaaaaggtgttatgttgcaaaccttagatgaactttggaaagaacacttagcttcgatggattatttacgccaaggtattcatttacgtggctatgcccaaaaagatccaaaacaagagtataaaaaagaatctttccgtatgtttacggaaatgttggattctttaaaacaccaggttatcacggctttaacccgtgtacgtgtgcgtactcaagaagaaatggaagaagctgaacgtgctcgtcaagaaatggcagcacgtatcaatcaaaataatttacctgtggatgaaaatagtcagacaactcaaaattcagagactgaagattattcagatcgtcgcattggtcgcaacgagccttgtccttgtgggtcgggtaaaaaatataagcattgtcacggcagtcgtgtggcacgccagtaatgaacaatcaaagtgcggtgatttttcaccgcacctttttcatacctctacattggatagaaaaatggataaaaaaattatacaagttgctgcggggattattcgtaatgaatttggtcagatctatttaacgcagcgtttagaaggacaggattttgcccaatctttagaatttcccggtggaaaagtagatgcgggagaaaccccagaacaggctttaaaacgtgaactggaagaggaaataggcattgttgcgttaaatgcagaactttatgaacgttttcaatttgaatatccaacaaaaatcatttcttttttcttttatctggtaaatgaatggattggtgagccttttgggcgagaggggcaagaaggtttttgggttgagcagcacgcattggatgcaggacagtttccccccgcgaatgcaaaattaattcatcgattactaaatgaaactcataatttcatataaaataaatgtggtttaaagttatattaaaagatttagtatgatttatcacatataactttttaatatactcgccaaaatatttgtattttttgcattattggagtcattatgtctcaacttgccaatccagaactgatgaaagtcgttattttactcgcatctagcgtaacaattgtgccgttatttaaaagactcgggttgggtagcgtgctaggttatttagtggcaggttgtttgattggcccatctgtctttggcatagtgcaagaaccaacagctgtggtacatttagcggaattaggtgtggtaatgtttctttttattatcgggcttgaaatgtatccagaacgcctttgggcaatgcgtaaagctatttttggtagaggtttgttacaagttggattatgtggttgcttactcactttttcgggtatttatttattaggattaacaaaagaagtatcatttatcgctggtatgggtttcacgctttcctctactgctattgtaatgcaatcactagaagaaagggggcttacttctacgtcaaaaggacaacgcgtaatttcgacattaatttttgaagatattgctattgtaccacttttggcttctgtcgcttttcttgctccccattcgaaagaagcgacaccacatactgattgggtatcaattggtatagcattaagtgctgttgtggggttaattgtgactggaaaatggctaatgaacccactatttcgtttaatttctaaagcacgtattcgtgaaatgatgacagcgggcgcattattggtcgttttaggtgctgcattagcaatggaaattggcggactttcaatggcaatgggcgcgtttgttgctggtgtgatgatgtctgaatcagcgtttcgccatcagcttgaagcggatatagaaccatttcgcggcttattactaggattattttttatgggcgtaggaatgtccttagatttgcatttagtgtttaatcattggatcttgctacttggaattgtttttctttatatacttggaaaagccagtgctgtttatattattgcccgaattacccgtcttgatcatcgagaagccataggacgaatgtctttgatggcacacggtggcgaatttgctttcgttcttttttcagctgcagcaactgcggaagtaatcagtaatgaagaacaagcgacattcactgctgcagtgattatttcgatgcttttttcgcctattattgctcaaattgctcgtaaacttatacagcgtacagagcctaaacatcttgatcaacttgatgaaaatgatctagacaccatcgtggatttggaagataacgttttagttattggttttggacgttttagtcaaattgtctgccaaacattattaattcgtggaattagcgtttcagtgattgatcgcaatatcgaaaatatccgtctgccgcaaagtttggttttaaagtttattatggcgatggcattcgattagatgttttacgagccgcaggaattgaaaaggcgaaatgtgtcgtattaggtattaacgatacacaaagaattgaacatattgtcagtcaaatgaaagaggcttatccaaatttaccgattttaacccgaacttatgacagaaaaacaacagttagtttgattaagcaggatgtagattttattgtgcgtgaaacttttgaatcagcaattacacttagtcgagcaacattgatgaaattaggtattgataaaattgaagcggaagaaattattaaggaagtacgaacattggatcaagaacggttaaatgaagaagttttacacggtttttcgaatgaaatagtaaaaaaatattggacaccaagaccatttattaaaccgcatcttgatacaaaagcattaaataaagaaacagaagaaattctaagtgagaaaattgaagaagaaatatcaaatgatcattcataaaattattttttatctataaaaatattaaattttaacttctcgtttaagtatttacttttgagtgatttaaatcacgtaaatttttattttaaggcaataaatgaataataaaattagtgtttatgataaagataatttctttgagctttatcagaaactccgtgcaaatccaattagcctcaatgaaattatcgaaaagcccaccatgctttcattgttgcctaatttaaaagggaagaaattactcgatttaggctgtggtacgggagggcatttacaactttatttagaacgaggggcggctaaagtaattggaactgatctttccgaaaaaatgctcgaacaagctgaaaaagatcttcaaaagtgcggtcaattttcagggcgtttttccttatatcacttaccaatagaaaaattagctgagttaccagaaagtcatttcgatgtgattactagctcttttgcctttcattatattgaaaattttccgacattattatcaacgatccatgacaaactctcgtctaatggcacattaattttctcacaagaacatccgataactacctgccataaagagggagaacgctgggaaaaaaatgataaaaaacagcaagtcgcttatcgtttaaatcattatcgagaagaggggaaacgcaatagaaattggttcaaacaaccttttcaaacctatcatcgaacaacagcaacaattatcaataatttaattcatgcaaggtttcaaatcgagcaaatggaagaacccatgcttgctgaccaaccgcaatggcataatgaatttaaagatttgtcacatcgaccaccattgttatttatcaaagcaagaaaagtggagaaataaacaaaataaactggtttttaaccgcactttatggtataaatcgccccgctgtttttgcctttcaaaagcagttttttaattactaacaacacacacatattaacaaggcttaatcggggtgccaaacggtcgattagctgatatgtggaggctcaaccccaacaaaaggaaaatattatggcacaagtttcaatgcgcgatatgatcaacgcaggcgtacacttcggacaccaaactcgttactggaacccacaaatgaaacctttcatttttggtgctcgtaacggtgttcacatcatcaatcttgaaaaaactttacctttattcaacgaagctttagcggaattaactcgcattgctagcaacaacggtaaagtattattcgttggtacaaaacgtgcagcgtctgaagcagttcaagcagcagcattagattgtcagcaatattacgtaaaccaccgttggttaggtggtatgttgactaactggaaaaccgttcgtcaatcaattaaacgtttaaaagatttagaaacccaatctcaagacggtacttttgataaattaaccaaaaaagaagcgttaatgcgtagccgtgagatggaaaaacttgaattaagccttggcggtatcaaagatatgggcggcttaccagatgcgttattcgttatcggtgcggaccacgaacatatcgcagttaaagaagcaaacaacctaggtattcctgtatttgctatcgttgatactaactcaacaccagctggcgtagatttcgttatccctggtaacgatgatgcgactcgtgctatccaactttacgtttctgcagctgcagcagcggttaaagaaggtcgtggtaacgaagctcaagttgctgaagaattagcagctgacgcagaataatttaagttttgcaataaggcgaagccttaataatcaagcgattaattggcataggggctaaaatttagcccctatatttttatctaaaagtgcggtcaaaataaaccgcattttcgacagaggattttaaaaatggctgaaatcacagcatcattagtaaaagaacttcgtgaccgkactggcgcaggtatgatggaatgtaaaaaagcattagttgaagcaaacggtgatattgagttagcaatcgacaatatgcgtaaatctggtcaagctaaagcagctaaaaaagcaggccgtgttgcagctgaaggtgttatccttgctcgtgtagaaaatggtttcggtgtattagttgaaatgaactgtgaaactgacttcgtagcaaaagatgcaggtttcttaggtttagcaaatgaagtaactgatttcgcagcagcaaacaaaggtaccactatcgaagcattacaagcgcaatttgaagaaaaacgtgctgcattagttgctaaaatcggtgagaacatgaatattcgtcgtgttgcttacctagatggtcaagtaattgcacaatacttacacggtgcaaaaattggcgtattagttgcgggcgaaggttctgctgatgaactgaaaaaagtagcaatgcacgtagctgcatctaaacctgaattcgtgaacccagaagatgtatctgctgaagtggttgaacacgaacgccaaatccaaatcgatattgcgatcaactctggtaaaccaaaagaaatcgcagagaaaatggttgaaggtcgtatgaagaaattcactggtgaagtttcattaacaggtcaagcatttgtaatggatccttctgtatctgtaggggatttcttaaaatcagtaaatacttctgtttctaacttcattcgtttagaagtaggcgaaggtattgagaaaaaagaagaagattttgctgctgaagttgcaaaaatcactggcggtaatgcgtaattctttaaagataacgatatgttaataagcccaacttaagttgggcttatttgttttataggataagctgcttaattaacgggcttaaacttttttagttacgtttagtaaaataaaaaatccacactttaatagtaaacttttaaagtgtggattttgtaataaaacctcagaagaaattaagaaattttcttttctaacgcttttaaacgtttatttattccatcaatacctaacgttagtgctgctgttttacgccattctttattcgtttgcaatggaataccagaggaatatacgccaggctctgtaattgggcgcataaccattcccattccagtaatggttactttatcacaaatttccatatgaccattaatcacacttgcaccaccaattaagcaatagcgaccaacagttaagctacctgccataataacgccacccgcaaccgctgtaccagtgccaatatgaacattatgtgcaatttgacaaaggttatcgataataacgttatcttcaataatcgtggcatctaatgcgcctctatcaatacaggtattcgcaccaatctcaacgttattaccaattattacttgccctacttgtggaattttaatccaacgaccacgatcatttgcataaccaaaaccatcactaccgataactgttcctgattgaattaagcaattagctccaatctcaacgttatggtaaacagtgacattagcccagagttgagtgcctgaacctatcttggtatttttaccaacaaagcaatttgcaccaatgatcacgttatcacctagtacaacaccttcttcaatcactgcgttcgcaccaatagatacattttcgcccaataaaacaccatcaaaaatgaccgcactttttgcgattccttgtgccgcttttggcgtgctatccatatattgcgctaaaattgcgtaagccacataaggatctttaacaataagtaaattgctttctggagaacagtgttcaacatcctcttcagaaacaatcaaaatccctgctttagaatctttcaataatacacgaaattttacgttagaaataaaagtgagttgatttgattgggctttatcgagaggcgcgatattctcaacaacaacatcggtgttaccgcgaacggtagcgccgatttgagttgccaattcttgtaaagaataggatttttgcattatgagaacctattattttttctcttgtgctttttcagaagcagggatagattttaatacttcttcagtaatatctttaccctctaccgcaaatacaattgaatttgcatcaagcacataagtataaccttttgcttttgctaaattatttgtcgcagtttgaatgctatctaataatttaccacgttcttcagcttgacgtttttcattttgagcttggaattcttgaacttttttatcttgttcttgcattaatttttgtaattcagcatcttcagccgcacctaatttattaatttcctgttggcgtttttgaatatcagcttgacgtaagcgaggtgcatctttttctaaagccgcaacttttgcttctacttttttacgagcagcagcaattttatcatcaacttcttttttgcttgctgctaatttctcagctacaggtttaaattcagcatcaagtttatctgctaccgcttggcgatctgggtgatgttgaaaaatataacctgcattaatgaaagcaattttttcttcagcggaagcatagcctgaagcaagtgcaatacctaaagcaagtgcggttacttttgcgatgtttttcatttgataaatatccttaattaaatgatgggtttaatattttctctgcccaattaaattaggcagagaacgttgtttttgagttctgatgaagaaaaaagttcaatttattagaaagaacctccaatactaaattggaactgttcgacatcatcattttcatattttttaattggtttggcataagagaataccaatggcccaataggagattgccattggaatccgacacctgtagaggcgcgaatacggcttgatttgccataatcgggtaagctttttaatacattgttatctaacccactcttatccgatttccacttagtattccaaacacttgccgcatcaacaaatagggaggttcggactgtattttggcttttatcactcacaaacggtgttggtacaataagttctgcactcgcagttgtgattgcattaccaccaatcacatcagaacttatcttcttaaaagtaccattaccattaccatgttctgcataaattgcgttaggtccaatactaccataagcaaaaccacgtaatgaaccgatgccacccgctgtataagtttgatagaacggtaaacgcttgtttccaaaaccatttgcatatcctgcagatgcttttgcagatacaacccagaggtgatctctgtctaatgggtagaaaccctgtacgtctgcacttagtttgtagtatttgttatcagaacctggaatagtaactcgtccaccaagacttgctttaacccctttagttgggaaatagcctctattaaggctgttatagttccaaccaaaagaaaaatcaaagtcatttgttttaatgccattacctttaaatttcattgattgaatatataaattacggttatattctagagcaaagttactaattttattataggtatggcctaatcctacataataggagttatttncatttacagggaaacctaaagtaacattacttccataagtcgtacgcttatagttagaggatgtatcacttttagagttatcgtagttttcaaagaaaacatttccaccaagacttacaccatctttagtaaaatagggctcggtataacccaaattgacactcgtaccataatcatttttcgtaccagctatacttactgccgcccctgttcccaagaaattatcttgtttaacacttgcttgataactaataccactctctgtaccgtaaccaataccaaagttgatactacccgtgttacgttctttgactttatatacgacatccacttcatcattactaccattgataggatcaattcggttttcgactgtttcgaagaaacctgtacgatctaagcgaatttttcctaactcaactaattgtgaattataccaagttccttcttgttggcgcatttcctgacgtaaagtgctatcagcagaaacggtatttccttcaaagcgaagttggcgaacagttaaacgtcgtccagcatcaacaacaagggttatcgctaatgttttatttgcatcatcaaaatcaggtactgaatttaccgttgcgctaccgtaaccgcgttctccaagttttgctttaattgcattttctacatctgcaatgtcactacggcggaaagtatcatttaaatgtaatgctgacagtaaaggttcaagctcggcagacatacctcccagattacctataatgcgtgcactacgaaggtcatactgtaaaccttcatttacatcaatggttacattaacttttgttttttcatcatttagctgaacatccgttttagtgatttgtgctttggcatagccattatttaaataataatcacgaattgactgcaaatctttctcgaattgcgcaccttcaaatttatttccccataatttccaccaagaatcaggttgtaattccatttgttcttgtaatgtactgctactaacagattcgttccccttgaaagttaatgatgccaattttgctttatcatcttcattgatttgaattaaaatttcagcgcgattatttggtagcgtattgacaataggttcaacggttgcgttatagcgacctacacttgcatagtgctcttttacacttttggcaaattcatttaatttttctcgaattaaaacatcgccaactttaaacccgttagcatctaagttttgttttagtgcttcagtgggaataatagagttacctttgattttaacatctgaaatgatcgatttagccacaacgctaacaacaagcacatcgccttcttgatgcgctttcacatcatcgaatcgaccacttacgaataaagagcggacaatattagccacatcattgtcagtcacacgctgaccagcacgaacaggtaaacttgctcggatttgttgttctaagtcaccttgaacaccatccacacgaatatcttttgccacaaaaggtgcggcaaacacagtcgttgtcgtaccgaataataaacttgcgattagaagttttttcatcgattgtatcctatataaattatagacgtaaaaaatcattaaataatgcaaacaccgttaagcttaataacagtgctgcgccaattcgataacagatgctttgcacccgctcagaaacaggttttcctttaacagcttccattgttaaaaaaactaaatgaccgccatctaatactggtaatggaaataaattcataatccctaaatttacactaatcaatgccataaaacttaaaaaatacaccaatccaatatttgctgatgcgccagcaccttttgcaatagaaattggcccacttaaattatttaatgacaaatcgccagtaagtaatttccctaatattttcaaggttaaaagggaaagctgtcctgttttttcaatgcctttttgtaaagattcaagaataccatattttaattcagtacggtattcatccgctaattttgttaaggctgggctaaccccaacaaaccatttgccattttgattacgcactggagttaggactttgtcaaatgtttctccattacgttcaactttaatagaaaaagattcgccttgttcgacctgttttataaaatcttgccaaggaagtgcggttaaattttcttttaaaattttatcaccgatttgtaaaccagctttctcagcgggagaattttgaacaactttagaaagcaccatttcaattttaggacgcataggcataatccctaatgcctcaaaagcactttctttttcaggatcgaatgtccaatttgtaagatttaaagtccgttgttgttcaatattagaattgaaaggagaaaggctaatctcaacattaggctcccccatttttgtggcaagtagcatattgatggtttcccaatcttgagtttcttcgccatcaattgtaagaatttgcgtattgggttcaatgtgggcttgtgctgcgattgagtttggtgttattgattcaatcactggtttaaccgttggcattccataaaggtaaatgacccaataagcaaaaattgcaaaaataaaattagctaaagggcctgcaataattacaaatgaccgttgtaatacgcttttactgtcaaatgcttgtgatttttgctcagcaggaactacttcattacgtccatcaagcatttttacatagccgcctaaaggaatcattgaaaccgcaaattctgtaccatatttgtcaatgcgtttccaaattacttttccaaaaccaatggaaaaacgatggacttttataccgcactttctcgctgcccaaaagtgaccatattcgtgaacggatactaatacagcaatagcaatgataaaagaacctagtgaccacaaaaatgacattaaaaatccttataagacaaagaaatagaaatagctgaaaaaaggtaccgcggcagtcaagctgtcaatgcgatctaatacgccgccgtgacctggaattaattgactgctgtctttaactcctgactcacgtttaaacatactttcagttaaatcgcccaatactgaaattgcaactgtggctacagaaagaatgataaatccagtaatatttcgatcgcctactaaagtattgttagagaaatgaataaagataaaagcaagcactaatgctgtaattaagccaccaatgaccccttcccaacttttacctggcgatactttaggggcaagtttacgtttgccaaaggcgcgtccgctaaaataagcaccagaatcagccgcccaaacaagtataaatacgtaaagtaataaaaataagccgtgataaggatcatgggtatagtgttctaaacgtaaacgtaatacacctgcgacaaatggaatcaacgtagaaaaggcaaataaaagttgtaaaagtggatttttagaccaaaatttagctgatttagggtaactgatcacaagtaacaaagctaaaccccaccagctaacagcatttatcaataaaagctgaagatgttgttcaaacacacgccctgcatctaaatagttgccctcagtatagagccataagaagataaatacgcctaaaaaggtagtcacaaaaaaacgtatcaaaggttgttttaggcgagcaaattgagtccattcccaaatgcctaaaatcgctactgcccctaaagcgagggcaaaataaaaaggtgtgaataaaaatagcgcacataaaactgcagcaattaacacaatagcagataaaactcgttgtttaagcataattttaatccgtttaactattcagtcccgccaaaacggcgatgacgttgttgataacttgcaatcgcgcgattaaattctaattgattaaaatcaggccaaagcacatcggaaaaatataattccgcataggcaatttgccataataaaaagttgcttatgcgctgttctccactggtgcgaattaataaatccacaggtggtgcattttgggttgcaagatgatgttgaaaagtcgagttattaatatctgaaactgacatttcttcttttttaactttttctgcaatttgtttagcggcttgaataatatcccaacaaccgccgtaatttgccgcaatattgagtgtaagtgcggtatttttttctgttaaattttccgcttttttgattttttcttgtaaagtttcactaaaacgagatacatcgcctataattttcagacaaatattatttttatgtaattttttcacttcgcgatccaaggcttgcataaaaagcgacattaacgcgctgatttcttgttctgggcgactccaattttcgctactaaaggcataaagtgtgagtacttccacaccgatttgtcgtgcataagccactgctttgcgtaccgcagtaacgccattggtgtgtccgaaaattcgcattttatttttctgttttgcccaacggccattaccatccataataatggcaacgtgttttggtatatttgtttgatccaactctatcattatttttattattgagagacctctataaatttggtggtaaactatatcataagttatattggcttgctatgaattcctttgttctaatctgttctgcaaaaattgaaaatttattgtaaaaaacaactaaaaaaccaccgcactttttatttctctccctattaatttttgccattttacggtattctatgccacattttctattgtcaaaatgctgcaaaagtgcggttaaaatttaaggtgattttatgcaagaacaatatcgccccgatatgatcgaaccaaaggttcaacaatattgggcagaaaataaagttttcaaagcaatcaaagacgaatctaaagaaaaatattactgtctttctatgttcccatatccttctggccgcctgcatatgggacatgtacgtaactatactattggtgatgtcatttctcgttatcaacgcatgttaggtaaaaacgtgttgcaaccctttggttgggatgctttcggcttaccagcagaaggtgccgcaatcaaaaacaaaactgcgcctgctaaatggacgtacgaaaacattgcctacatgaaaaaacaacttcagcttttaggctttggtttcgactgggatcgcgaaatcgcaacctgtaaaccagaatactacaaatgggaacaatggttcttcacggagctttataaaaaaggcttagtgtacaaaaaaacctcaaccgtaaactggtgcccgaatgatgaaacagtactcgcaaacgagcaagtacacgaaggttgttgctggcgttgtgatacaccagtggaacaaaaagaaatcccacaatggtttatcaaaattactgactatgcagagcaattattaggtggtttagatacccttccacaatggcctgacatggtaaaaaccatgcaacgtaactggattggtcgctctgaaggggtagaaattacctttgatgttgcaaataccaacgaaaaagtggcggtttacaccacgcgtccagataccttttacggcgtgagttatttaggtattgcagcggcacatccattagcaagtttagcagctcaaaacaattccgaattagccgcctttatccaagaagcgaaaaacgccaaagtggcagaagctgatcttgcgacaatggagaaaaaaggaatggcaacgggattatttgctattcatccattgacgggggataaattaccgatttgggttgcgaatttcgtattaatgcactacggcactggcgcagtaatggcggttcctgctcatgaccaacgtgactttgaatttgctcaaaaatacagtttgccaattaaacaagtgatcgcaccgcttgcagatgaagaaattgatttaaccaaacaagctttcgttgaacacggtaaattagtgaactcagacgagtttgatggtaaaaattttgatggtgctttcaacggcattgcagataaattagaaaaattaggtgttggaaaacgtcaagttaattaccgtttacgtgactggggcgtttctcgccaacgttattggggtgcaccaattccgatgctaacccttgaaaatggcgatgtagtacctgcaccaatggaagatttacctattattctacctgaagatgtggtaatggatggcgtaaaaagtccaattaacgctgatcctaattgggcaaaaacaacctttaacgacgcaccagcgttaaaagaaacggatacctttgatacctttatggaatcctcttggtattacgcgcgctacacttgtccacaatatcaaaatggcatgcttgatgcggaagaagcaaactattggttacctgtggatcaatatatcggtggtattgaacatgctacgatgcatttactctacttccgcttcttccacaaattattgcgtgatgcaggatttgtaactagtgaggaaccagccgataaattattatgtcaaggtatggtgcttgcagatgccttctactacacaagtccaaccaatgagcgtatttgggtaagtccaacacaggtaactcttgaacgtgatgaaaaaggcagaattattaaagcgaccgatcctgaagggcgtgaattagtccacagtggcatgaccaaaatgtcgaaatccaaaaataacggtattgacccacaagaaatggtagaaaaatatggtgccgatactgttcgcctctttatgatgtttgcctctccagcagaaatgaccttggaatggcaagaatcaggcgtagaaggtgcgaaacgtttcttaggacgcgtttggaatttggtatatcaatatcaacaaaatccagcaaaaactagcctagatttgaccgcactttccgcagaacagaaagtgcttcgtcgtgaagttcataaaaccattgcgaaagtgagcgatgatattggtcgtcgtcaaacatttaatactgcgattgctgcagtgatggaattgatgaataaactgactaaggcatcgcttgatagcgagcaagatcgtgcagttatggcggaggcattaagtgcagttgttcgtatgctttatccaattacgccacatatctgttttgaattatggcaagctcttggcaatgaaagtgctattgatactgcagaatgggtaaaagccgatgaagccgcaatggtagaagatgaaaaactgattgttgtgcaagtaaatggcaaggttcgtggcaaagttactgttgcgacagatgcagatgaagacacagtcaaaacgattgcttttgcggatgaaaatgtgaagaaatttattgataatcaacacattgtcaaagtgatttatgtcgtaggtaaattattaaacgtggtagtgaaaccataatacatagggtgtgtggatttaaaattcacgcaccattttttataggtatgtgaaatatttacattttacacgtcctacaataaaggtaatttttatgatcaactcaatcaagactttactgcttatcgcaacattagcaattctttctgcttgcggttggcattttcaacagtcggttactatgccaagtgaatggcgaacattagcccttgaaagtgatgactcttataatgattttactgttattatgcgtcgcaaattgcaggaaaatcaggttaatgtcgtcaatttagaacaaaatattcccattttacgtattaataaacagattacttcagatcaagttgcgtctatttttaagcacggacgtgaggcagaaaaacttttaatgttggaagtagaagccactttccgccttgctaatggcgaaagctatccaatcaatgcgaaagtaaaccgtactttctttgataatgcacgtgcagcattagccaaatcagaagaacgagaggtaatttggaatgatatgcgcgagcaagtagcgcgtcaattaatcgtaaaaataattgcgttacaaaatcaaataaaaaggaaataatgaaccgcatttttccagagcaactaaatcatcatcttgcgcaaggcttggctagagtttatctcttgcaagggcaagatcctttattacttagtgaaactgaggatactatttgtcaagtggcaaacctgcaaggttttgatgaaaaaaatactattcaggttgatagccaaactgattgggcgcaacttatagaatcttgtcaatctataggattgttttttagtaaacaaatactaagcttgaatttacctgaaaatttcaccgcacttttgcagaaaaatctgcaagaacttatatccgtattgcataaagatgtcttgcttattttacaggtagcaaaattggctaaagggattgaaaagcaaacgtggtttattacacttaatcaatatgaaccaaatacaatactgataaattgtcaaacaccgacggtagaaaacttaccacgttgggtaaaaaatcgtaccaaagcaatgggattagacgctgacaacgaagcaatccaacaactttgttatagttatgaaaataacctgctcgcactcaaacaagctctgcagcttttagatttgctctatcctgaccataaacttaactacaatcgtgttattagcgtggtggaacaatcctcaatttttacaccatttcaatggattgatgcgttgcttgttggaaaggcaaatcgtgctaaacgtattttaaaaggtttacaagctgaagatgtgcaacctgttattttattacgcacactacagcgagaattatttacgttgcttgaactcacaaaaccacagcaacgtattgtgacaacggaaaaacttccaattcaacaaattaagactgaatttgaccgtctaaaaatctggcaaaatcgccgaccgctctttttaagtgcgattcaacgtttaacttaccagactctctacgaaattatccaagaactcgctaatattgaacgccttgctaaacaagaatttagtgatgaagtgtggatcaaactcgctgatttatctgtaaaaatttgtttgtagtcacaaggcaaataaaatagacaatattgaaataagatttttgataaaaaagaaatttttttgctggaaaaatggtcccccctaccggacttgaaccagtgaccaagcgattatgagtcgcctgctctaaccgactgagctaaggggggaaagtgcggtaattatagagaaataatcacttgaagtctataaaagaagggatgattgacgaaaaattaaccatccctttttacattattgaagcactgaaatatcagctacttgtaagaataacccttgtaacgtatttaaaatcgctaatcggttttgacgtagtgctggatcttcagcatttaccatcacgttatcaaagaaactgtctactggcgcacgtaagtttgctaatttatccaatactgtcgtgtaatcgccttgtgcgataagcggttgtacttcagtgcgtaatgcaagcaccgcttcagcaagggctttttctgctggctctacgcaagcggttaaattgatctcgccaattgccgcacctgctttcgctaagatgttgctgacacgtttgtttgctgctgctaacgcttccgctgaatctaaagtacggaagtgtgaaaccgcacgcacgcgcgcatcaaagtctgctgggcgagttggacgacgtgccaataccgcttgaatcacatccaccgcaatgccttcatcttgataccatgcacggaaacgaccgagcatgaagtccaccacatcagcaaccacattttgattcgtgagtttatcaccgaaaagtgcggctgattttttcactaaatcttctaaatcaagtggtaagtttttctctacgataatacgtaacgcacctaatgccgcacgacgtaatgcaaatgggtctgcgctaccttttggtgcttggccgatgccgaagatacccgttaaagtgtcaaatttatccgctaaagcgaccgcacttgcaacgagagattttggtaattcatcaccagcaaagcgtggcatatattgttcgtttaacgccaccgctacttcttcatcttcaccgtcatgacgagcgtagtgcatacccattacgccttgcgtatcagtgaattcaaataccatgttggtcatcaaatcacattttgacagtaaacccgcacgttttgctttcgcttcgtctgcgccgatttgttttgcaatttcgcctgcaagttgctcaatgcgatcagttttatctttcaatgtacccaattgttgctggaacaacacggtttctaaacgtggtaaacgatcaaccagtttttgttttaagtcggttttgaagaagaattccgcatcggttaaacgtggacgaaccactttttcattcccttcgataatcgcggttggatcttctgggttgatgttcgagacaaaaataaagtgcggtaataatttgccgtctttgtcataaattgggaaatatttttggtctcctttcatggtgtaaaccaaggcttccgcaggcactgctaagaaatgttcttcaaattttgctgctaaaacatttggatattccaccaaggaagtgacttcttcaagcaagctttcttcaatatcagctacgccgccaagtgcggtcgcttttgcttgagattttgcaagaatttctgctttacgctcgttgaagtccgccaccacagaacctttttcacgcaataattgcggatattggtctgcatgttgaatgtaaaattctttctcgcctaagaaacggtgaccgcgaatggtgcgagcacttgccacacctaaaatttcgccttcaattaactcatcgcctaacaacatagtcacagtgtgaactgggcgaataaactgcacggttttatctgcccaacgcattggttttggaattggcaatttcgctaacgcatttgccacaatatcgttaagtaagtttttggtcggctgaccttcaattttcgcacgatgaatgagccattcgcctttatcagttgcaatgcgttctgcttgctcaacggtaataccacaaccacgtgcccagccttcagccgcttttgttggtttaccttccgcatcaaaggctgctgacactgcaggcccgcgtttttcgatttctttgctcggttgctgtgtggctaagttcaacactttcaccgccaaacgacgcggcgccgcaaaccattcgattttgtcgaatgataaacctgcttgattcaattccgcctcaacgttatccgcaaaagaggttgctaatgttttgagagcttttggtggcagctcttccgtgccgatttctacaaggaagttttgggttgtcattttgtttctcttatttaaaaattctgtagatttaaantcttattttctcgttatcatttctgccaaatcgcccctacccctctttgctaaagaggggattggatctttggagagttaaatatttatgttctactttaacgttttttgaaagcagataatttaatctctattgaaattaaaatgtaaatgagccagttactatcaatttattcaagaattcccctctttagcaaagaggggtaggggagatttactcgcttcgctcgcacttcgtgccgttgctaaagcaacgttcaaacgcaagcgtttgtggcagaggttaatccaacctcatactcaatcagtccttacattctctaaaaacaaataaatctgctctactaccgcttcaatttcacgcatgacttcatcattgctaaaccgcatcactgtaaaaccaagtgaatttaattctgcatctcgcaatgcatctttttcctgataatcaggtttatagtgctgactaccatctaattcaataatcagctttgtctttgcacaataaaaatcaacgatataacttaaaagtggcttttgtcgattaaatcgaaatcctaataattgatctcgattgatgcgttgccatagctttctttctgtatccgtttgatccgctcgcagtttctgcgaattcagctttaagtatttttcatagggttgcatgaaaactgctgttctatctttcccaaaacttaaaaaattacttttaactttgataggtctaaaacaacatcgccatttggtaataacaatgcaggaatgcctaaatagccatttgctttcgagttatcaaattctgcactgctatcgcgtaaacgaatgaattgtttgagattaggtaatgaagtcataatttctacttcatcgtaatccacacctaagcgatccaactccgcgacaaatggcgcggtatctgggcatgtttctgcataaaaaagaatgggtttgctcattttgctctcctaaagtgcggtcaaatttcaccgcacttttttgaattacctttaaatgttattttttacaacctgggaaacctaaggcttcacggcttgcataataagcttccgccacgcctttagttaaggctcgaatgcgtaaaatatagcgttggcgttcggtcactgaaattgctttacgtgcatctaataagttgaagctgtgtgctgctttcaaaatacgttcataagctggcaatggtaacggtttttctaaagctaataactcttgtgcttctttttcgtattgatcgaagcagtagaataagaaatctgtgtttgcgtgttcaaagttataggttgattgctcgacttcgttttgatggaatacatcaccgtaagtggttttaccaagcgggccatcagaccaaactaagtcatatacagaatctacgccttgaatgtacatggctaaacgctctaaaccataagttacttcgcctgttacaggtttacattctaagccacccacttgttggaaataggtaaactgggtcacttccataccgtttaaccatacttcccagcccaagccccatgcacctaaggttgggttttcccagttatcttctacgaaacgaatgtcgtttttggtcggatcgaagccgagcatttcaagcgagcctaaataaagttcttgaatattatctggagaaggtttgattaccacttggaattggtagtagtgttgtaaacggtttgggttttcaccataacgaccatcggtcggacgacgtgaaggttgcacataagcaaatgccattggctctgggcctaatgcgcgcaatgcggtcattgggtgagaagtacctgcgcccacttccatatcaaaaggttgcacaatggtgcagccttggtttgcccaatattcttgcagggctaaaatcataccttggaatgtttttacgttaaattttgtactcataatcgttgatctaatgtgattaaaaatgttggtattatacttgaatccgtaaaagggataaaggcgaaaaatgcggttgaaaatcaggctttataaagatatatcaagtaagtaattttgaatatttaggtagattttaagttttattttagtatagttttttttgattaatttaatagatttcgattgtttaaacctttctatatgatacgcaagaaattcatttcaacctaactaaatttattaactttacaaggagtctacaatgagttctcaatgtcctttctcgcacttagctgcgacaaacttaacaatgggtaacggtgcacccgttgctgataaccaaaacagcttaacagctggtccgcgtggtccattacttgcacaagatttatggcttaacgaaaaattagctgatttcgtacgtgaagtgatcccagagcgtcgtatgcacgctaaaggttctggcgcatttggtacttttactgtgacacacgacattactaaatatactcgtgcaaaaatttttagtgaagtgggtaaaaaaacggaaatgttcgcacgttttaccaccgtggcaggcgaacgtggtgcagcagatgctgagcgtgatattcgtggttttgcattaaaattctatactgaagaaggtaactgggatttagtaggtaacaatacgccagtattcttcttacgtgatccacgtaaattcccagatttaaataaagcagtaaaacgtgatcctcgcactaatatgcgttcagcaactaataactgggatttctggacattattaccagaagcattacaccaagtcactgttgtaatgagtgatcgtggtattccagcaagttatcgtcatatgcacggtttcggttctcacacttatagtttctggaacgaagcgggcgaacgtttttgggtaaaattccacttccgtactcaacaaggcattaaaaatttaacagatgctgaagcagccgaaattattgcaaatgaccgtgaaagccatcaacgtgatttatatgaagcgattgaacgtggcgatttccctaaatggacattatttgtacaaattatgccggaagcagatgcggaaaaagtgccttatcacccattcgacttaactaaagtatggtcgaaaaaagactatccattaattgaagtcggcgagtttgaattaaaccgtaacccagaaaacttcttcgctgatgtagaacaatctgcgtttgcaccaagtaacttggttccgggtattggcgcaagccctgacagaatgttacaagcccgtttatttaactatgcggatgcacaacgttaccgtttaggtgtgaactaccgtcaaattccagtaaaccgtccacgttgccctgttcatagcaaccaacgtgatggtcaaggtcgtgtagatggtaactacggtagcttgccacactacgagccaaacagcttcagccaatggcaacaacaaccagactttgctgaaccaccacttcgtatcaacggagatgcagcacactgggattatcgtaacgatgataacgattacttcagccaacctcgtgcattatttaacttaatgaatgcagagcaaaaacaatcattattcaacaacacggcagcagcaatgggcgatgcacctgatttcatcaaatatcgtcatattcgtaactgccactggtgtgatgccgcatacggtgaaggcgttgcgaaagcattaggtttaaccgttgaagatgcattaaaagctcgtgatactgatcctgcattaggtcaaggtggattgttataatctttcgagttaattattttaaataaataatagtagtaatgaatctgcacctaaaagttaggctaaggtttaactgattagggtgcagatttttttcaatgaaatattactaattcattacataatacttgaacgattttgtaatcgttcaaaaatttgaatgtaaaaataacctataatagcttccattttttatggtaaatattgtatttaagtaatgctaaatatatatcatggcacaaaataatgaggtataaaatggctatcattacccgtcactgcagtaaaatcttcacgtaagcccattccacaagccacatcacccacaacccaagagccgataattggatacattccatcaaaacttggcaattcaaatttttgttgataaacataacctgaattaccataaaacgttgagtgttcgcttcctttcgctgcaaattctacaccattatttttctcataatagaaaacattggcaccttctcgacctaacaatggttttttcacccacatcgataaatcttttggtagttcgaaaggcgtaaaataagcaggcaataaatgcggatgattaggataacgcgcccaaagttttgccaatagtgctttattacttaacaacattttccacgctggttcaataaatcgtgtttcagccgttgtaatatggcgagcaaactcagcgtggcttagccattctagcggatacaatttaaataacatttcaataggttgatcatttaaatctacaaatttttttgtttcgctgttatagccaatatcttccaccgctaattgatgaatattccaacctgcgttataagccacatcagctaaataatccacattgccccaatcttcacggccagcatcctgcatggcactcaaatggaaatctgttttgccactttgttgttttaaaaattggaaatgttttattaattcttcatgaatccagttaaattgatcacgatgtttcaagccctcaatttgctccaaccactgccattggacaaccgctgcctccaacaaagatgttggtgtatcggcgttatattcaaacatttttaggttgttgccatcatagccaaaatcaaagcgtccatataaataaggttcttgattacgccaagaggtttcaataagctgtttttgcaactccgtaaaatgataattttcataatcgccttttttaatttcatccgccgcaaaatctaaacacattgaatgcaattcattagttgtatcctcaatgcgatcaatttccgctaaggtaaattcataggcgacattatcagaccaataatgagatccatcactggaaggcaagttataataatcaaatccaacattaagtagctgttgcaccatatctggtcgagtaggaaacccagttacacgtttcatttagcccccactgctacgatgagttttatttgggctactaaaaccaccacgagatacaggtttgctattcatgcttcctgcatttcctttcacgagcattggttttccaacagagcgatttgtttgcggttgcacaacttgccctgttggtgtggtgacagctcgatttccaggatgatagcttgggccaaggaaactactaattgcacgagccgccatataccctataacgccaccagcaattgcggctcctaaagaaggatcggtactttcagcttttgtagttgattcagctctgttctcgctttgattagcttgtgcattattttcagctggattttttaccgcactttctgcattaccattatcacgaatatttaaacccagcccctgctgttgtgtagttgcagttttctgagtactttcagtatttttatctgcctcacaaagctcaatttttttccaatccgctaaacaatcgtctaaagactgatatacatcgcgttgtacttgctcttctgaacagcctcctaataaggccacaatagataaactaactaaaatctgattttctttttcattgttctcaatttttatcgaatggtttttacgcctagccattgctcggcctgtttattagtaatttcttcacgagtccacatgctcattaaatctggttgtggatatttattgctgttatagccgactaaacgggcaaaatcaaatacagcatgaggatagccattaataagcaataaggctacataaccactctcatcccaacaaatttcaagtttgcgtgcttcatgatgattagaggttgaatcaacattatacacgtgcaacatatccactatcggttgagcattttgacgcatatcaagcgcataaaaatagccagtttccccgtcatcttcaaacattacggcaaaatgctcaaatactgtcgaatgtgttcccacttgctttggcgttcctaaaaagagctcgtcctctaaagttaaatgtaacattctctttcctttaaatattagatataaaaacaccgcacttttatacaaagtgcggtgagatttcacagtaaattcagcgtgaattacgcttgacctttaaccgcttttaagcctgggaatgctgctggagtaccagcgcgttctaatgcttcttcgatacggattaattggttgtatttcgcaatacggtcagaacggctcatagaaccagttttgatttgacctgctgctgtacccaccgctaaatcagcgatagttgcatcttcagtttcgcctgaacggtgagagattacagcggtgtaacctgcatctttcgccattttaattgctgctaaagtttcagttaaagaaccgatttgattgaatttgattaagatagagtttgcgatacctttttcgataccttcttttaagattttggtgttagtgacgaataaatcatcgcccactaattgaacgcggtcgcctaacactttagtttggtatgcaaaaccttcccagtctgactcatcttgaccatcttcgatagacacgattgggtactctttgcataattcttctaagtagtgagtgaattcttgagaagtgaatgatttaccttcacctttcatttcgtacataccattttctttgttatagaactcagaagatgcgcagtccatcgctaaagtaacgtctttacctaatacgtaacctgctttttctactgcttctttgatacaggctaaagcgtctgcgttagaggctaagtttggtgcgaaaccaccttcgtcaccaactgcagtgctcatgcctttagcttttaatactttcgccaagttgtggaatacttcagcaccgatacgaagtgcttcacgtaatgttttcgcaccaactggttgaatcatgaattcttggatatcaacgttgttatctgcatgttcgccaccgttaatgatgttcatcattggtaatggcatagaataaacaccagcagtgccatttaattctgcaatgtaagcgtaaagtggtaaacctttagatgctgcagctgcttttgcgtttgctaaagataccgccaagattgcatttgcaccaaagttagatttgttttcggttccgtctaaatcgatcatgatttggtcgatttcagcttggtttgttgcatctttaccaacgatagcttgtgcaatttcgttgttcactgccgccacagcttttaatacgcctttacctaagaaacgagatttgtcgccgtcacgtaattctaatgcttcacgagaaccagttgatgcaccagatggagctgctgctaaaccnacaaaaccaccktcaagatgaacttcagcttcaacagttggattaccgcgtgagtcgatgatttcgcgaccaatcactttaacgatttttgccatttttattttcctcaattaagttaattaaaacgggttaggcgagcctaaaacaggcgatatgataaagctattttragattttttcttgtaaaaaatgcgtatgctttgatctttatctatttattgtcttgagatacttagagcacaagcataagccgagctccacgcccattggaagttataaccaccgagccagcccgtcacatccaatacttcaccaataaaatataaaccgctgacttggttgctttccattgttttagaagaaattactttagtatccactccgcccattgtgacttcagccgtacgatagccctctgtgccatttggagtaaattcccagtgatgaataaaatccaccagattttttacccgcactttgctgatgttagcgataacttcatcttgcacaatgccttgttcaatccaaagttcgaccaattttttcggcaataatcgaaccaagatggttttcaacatttgttttggagaagattgttttgcttgattaatttcctcttccacattgtggttcggtaataaatcgatttccactgactcagtgggctgccaataattagaaatttgtaacaccgcaggcctgaaataccacgatgagtaaacaaaagctggttgtaaaaagattttccgcacagtgccgtgatagtgacaggcaagctaatacctgaaagtgcggttaaaaatttatctgtttctcgataagtaaaaggcactaaactcgcacgaggcggaataacaggaatgccaaattgttccgcaatttgataaccaaatggcgttgcgccaagcccaggcatagaaagcccacctgtcgcaacaatcaaatttttacattgccattgggttgaatttacctgtaaaacaaaccgcactttttcatcattttgaatccgttcaacttgagaaacttcgctacgcaataaaatcttagcaccatatttatcgcattcagatttcagcatttcaacgatttgttctgcaccctcatcgcaaaataattgccccaattccttttcgtgataagtaatcccttgctccgccactaaagaaataaaatcccagttggtataacgagctagtgccgatttgacgaaatgaggattttgcgaaagataatgagctggcgtaacctctaaattggtgaaattacaaaacccaccgcccgacatcaaaatcttacgtccgatttttttgccgttgtcgaaaactgttaccgacttgcctagcttagccaattgtgcggcacaaaataatcctgccgcacccgcaccaataataatattttcagaatattggctcacggattttgtcctttttcaccacgttgtaaaaaatccaacatcttcattcgttgaataactgaacgacgatccactgccgcattacctgaatctaataactgctgtaaatacataccggcttgttgatattggcgattttctaaggcaattgtcgccaacaaagaaagactagatacttcatttttatcttttgccaaagcttcattcaaaagttgttcgactttttgggtcatttgctggcctgcttgataataaagtgcggtggctgccaagcctaaaatattaggtttacttcccgacaatttttccgcattagaataagccacaagcgcgctatcaaattcattattctgcacataggcttccccaagttgaagccaagtttccgcattattcggatcagttcgcagtttattttggagcttctcaatcacattttcatttttgtgttcatcattcatttcaacattttgattatgttgctcaatcatcgattgctcgccttgttgaacacgactaaaacgatcaagggaaaaataataagtagctggaatagcgatgagtaaagtaaaaagcacaaaataaattttgctattcacttttcccttagaaagtttacttggctccccttgcttgcggggggagctgccaaaggttgaggggagggaaattatttcatcattctctagttgttgtgcaaccactttttctgaaaactgttttttcctatttgagaaataaagcaatactgcagctaaaattaaaagggcgactggcaataaccataacaacgccgtattccatttgaatggcggtttgtaattcamaaaatcaccaaatctagccgtcattttatcgataatttgctgattgcttttgccctcatccaccattttgtacacttcaagacgcaagtcataagcaattggagaattagattccaccaaattttggttctgacattgtggacagcgtaaagattttgccaactctacggcgcgagtacgatcatcttgattttgaaattgataggtatccaccatttccgcttgagtaaacaaggaaaatgcgaataaaagtgcggttgcaaaaaagactgttttttgaacctgaataaaaccgcgagtaaaaatatctaatatacttttcatttgttcttcaatgcttcaattttcggcaaaaataccgtttgccaagtttctttatccaataaaccagaatggcgataacgaatcacaccattttcatccacaagataagtttctggcgcgccatccacgcctaattttaatcccaattccccatgactatcatcaatggttaagatgaacggattgcccattcgcttaagcattttaatgccattttgccgattatcgcgataatccacgcccacaataggcaacgtttttgcaatctcaattaacagaggatgttcttctttgcaataaccacaccaacttccccaaacatttaataaaaatggctgtttaggaaactctttcgggcttacgatttgtgatggctcatgtaaattagcctgataaaactctggaacaggtttatcaattaaagccgacgcaatttttttcggatcttgatttaaccctgcaattaataatatacacacgcctaaaagcacaaagagcggtgtaaaaaagataagttttttgttcattatttttcctgttttctgcgtaatccgaaaacgctaaaaagtgcgccaaaggccattaaaataccgcccgcccaaagccaacgaatcagtggtttataatgtaagcggaaagtaaattcccctttgccaagagaatcgcccatcacaatatataaatcgccccaaaaaccaccatcaagccccacttcactcattgtcattgttcgtacatcgtaataacggcgttctgggataatttctgcataaggtttaccatttttagttacgtcaaaaaaggcgacttctgccgtaaagtttggcccaatttcattagaaaattggcgataatgaaattcatattgccctaacgtttgactttgttgcggtgctaaacgcacaccaatttcactgccaaaatacccactcatcaccgcaccaatagtcacaatcgccacgccacagtgtgctaaaatcatcccaaattgagacaagcgaatttgtcgccaattttgccataacgtgacgaataaaagccaaatcgcaagagttaataacacaaaggcgaaagcatggaaatgtaatgcagaattatttcgtagctgttgccaaatcattaggcctgcaagaattaaagacggaataagcaaccacccacaacgtatcaataatgtgcgatcaaattgccccttacgtatgctaagcacaattaccattaagattaaaatcgccgtaataatggggaagnaaatactattaaaataaggacttcccaccgaaattgagccccaattcatcgcttggaataacatcgggtaaaaggtacctaaaaaggtagaaaccgtcgcaatggtcagcaaaatattcagtaataaaatgccacccgatttagaaatgaactgaaatttcaccgcactttctgatgaacttcccgctcgtaaagcgaataaaccaaaggctaacgctgtcaaaacaaagaaaattaataacaacacataaccgcgcgtgttatccaatgcaaaagcatgcacagaagtgagtgcgccagaacgaacaataaacgtgcctaatacgctaaaggcaaaagcaagcagagaaaaaagcgttgtccaataactaaatacgccttgtttttccgtcgccattaaactgtgtaataatgccaaaccaagcaaccaaggcattaaagacgcattttctacgggatcccagaaccaccaaccgccccagccaagttcgtaataagcccaccaagcaccaagcacaatgccaatggttaaaaataaccaagaaaccaacacccatccacgcattgagcgggcaatttgtcgtgcagattggttataaatcaacgcactcaaactcattgcaaaatttaccgcaaagcccacatagccaacatatagtaaaggtggatggaaaattaatcccacatcttgcaacattggattgagatcgcgcccttctgcgggtgctgggaaaatgcgtccaaatggattggaataaaataaaataaacaccgcaaaaccaaagcaaatcaatcccaataaagataaagattgagcagaaaaagtgcggtcattttttcgattaaaaaaagcaaaagcagcaagccataaactcaatgaaaataaccaaaacaacattgaaccttcatgtcctccccaagtggcagccactttaaaaaatgtaggtaattgggaattagaatgtgccgctacatattcaagggtgaaatcatccaccgcaaaagaataagcaagcaaaccaattgataacgtcgtcgcaagggtaaaaatataactaagcggccaagcagcattaattaaagtcggattttttttgaataacccaaattgaggcactaacgcaaggaaaaacgcgctagctgttgcgagtaaaagaaggaaaaagccaagttctggaagcataatgtcgtcgtttttttcgttgatgcgcagataaagtcgctaatcaagtatgtttcattaataaaattaaaaatagcaccttgataggtgctattgtgcttataaaaattaatgattaaattcagcacctaaacaagggcgaattttatttaacatttctttaattacgcgtgatggtgcagcaatgatattgccactgcgtaagtagtgttaccagcatcaaaatcgcaaactaaaccacccgcttcacgcacgattaaatcgccagcagcacaatcccatgcttttaagcccatttcaaaataaccatcaatacggtttgacgccacatagcataaatccaatgcggcagaaccagtacgacggaaatccgcagcatcttcaattaaggcattcatcattgcaaattgagctggcattaattttggttgtttgaatgggaaaccagtggctaaaattgaaccttgaatttcacgtttactatctacacgtaaacgtacttcatttaattttgcaccttcgccacgcacagcggtaaataattcattacggattggatcgtaaacaaccccgacttcagtgcgattttttacacgaactgcgatagacacagaaaagtggggaagccctgtcataaaattacgagtaccatctagcggatcaataatccattgtacatcgctatctttgccttcaattgcgcctgtttcttccgtaataattgtgtgatcaggataagatttacgaataacttcaatgatttctgcttcagacgctttatcaacgtttgttacataatcattaatacctttttgtgtgctttcgatagcatcacggcgttcataatttttagcaatcacattgcccgcttttcgtgccgcacgaattgcgatatttaacattggattcatatttccaccagcttttaaagaacagaaaaattccgtgccattatagcgagatttgccaaaataactagttgaaaatcataaaacagtggtttttataggttttcagaaaaactttgcgatacagatcgcnaaaatcagatcaagtgatttttctacccattcatttatggttaaagtgcggtggaaaattggagcgttttatgcagaaaggtatgacattagtggaattattgattgggttagccattatcagtattgcgctgaattttgcagtaccattatggaaaaccgattcacctaaaacgattttagccaaagagcaacatcgcctgtatttatttctacgccaaattcaggctcgggcagaaaattcatcggaagtgtggtttttacttatcaatcgtaatcttgcgacacagcaatggtgcttaacggcacaagtaaaaaataaccaaacttgtgattgtttaaatccgataaattgcccgaaagaggtttatgctcatttttactacccttattttcctaacaaaacgatgattcaaagtcatcatatttatccaaaagaaatcacgagatttgatggcattcgtaatactattgttactcgttgctttattttgcaagctgaaaatgaacgtacgttattttnatttttcaatgttggcagtattcgtgtgaaaactaatcaatttgatagtgcttgtaattaatgatgaaagtattattaaaagggcaaaccctattagcactgatgatttcactgtctttgtcgtctttattattgctaagcatttcgcatttttatgtgcaaatacaaacgcaaaatcaacacatgttattacatttaaaattacaagctgaattacaacgaacattacagttaataggtaaagatcttcgccgattaggatttcgagcattaaatgcaaaactgacggaaagcaatttatctttatttgaattagatgaacaaggcacagctatttttattagccaagaagataatgcgccacctaatagctgcgtgttgttcttttatgatttaaataaaaatgggtgtattggcaaaggttcgccgaaaacctgtatgaaaaaaggtaaaaatacatctaaaagtagtactgaagaattattcggctataaagtgagtaacaaaatgataaaaactaaactgacttatcaaagtgttattcctactaattgcacggcagaaacttgtaaacgtgcttttcaacaaaccgcttgtaacgctggtggtggatgggcagatttattagataacaacgaatatgaaatcactaggttacaatttaattggttaattgaaggcaaaggattagaaatcaagctaaaaggaaatttaaaacaaaccccaaatatcagttatgaaacatcccttgttgttgtgctctggaatcaaaaataatgactatacaaaaaggcattatcacgctgactattctgattttwatttcaggtttattaactgcgtttttattgttggatgacagccatttaagttttttncgtgcgcaacaaaatcaacgaaaacactatgtggaaagaacattacaactgcaaaaaatgaccgcgacgaaaaaacaaactgcctgccttgatttacccttaaataataatgaaagtgtgaagcaaatcagcatcgcccttgagggttccaccgatgcaattcaatattttctttggtgtgaaagaatgagcctatttaaaaaatcgcctaaaaagggagataatcaaggtgcattgaaagattttgtgactgacgaaaaacttgcctattttcgaccgcacttttcttccccgcccagaattttaaacgcgaataaaatgcctaaactttattggttttcagattcacaagcagaagttgaaattaatggcaccgtatctgccgtattaattgcagagggcgatttaaaattgactggcaaagggaggattagtggtgcagtgattaccagcgggaatttaactttagatggcgtaactttagcttatgggaaaaagacggtggttgctttagtgcaacaatatagtcagtggcagttagcagaaaaaagttggagtgattttaatgttcaggatgaataaaggaatgtcttttattacattgttattttctttagctttatttagcgttttatttcttgtttttaatcaatggacggcaagccaaagaaaaagtacggtgaaaacttatcaagattttcaggcaatacaggttgcggagaatcaggctcaacgccaatttttagggttagcttgtgaacaattgatacaacaaaatggcttaacttttcgtattcaatgtgaaaatgaacgtattattgtgcgttatcctacgagtgaaattttgataaaaactcagtaaaatggcgttgttttttctaggttaaatcatcaaaaggtcgccattgtgttcattgtttattattccaatcagcttgaaaaacaaaaagaaattctttcttccctattcaaatctttaccgcctgaagatccttttcaacaagatattatcttggtacaaagccctaatatggcgcaatggctacaaattgaacttgccaaagaaacaggtatttcagcaaacctaaaatttcctatgccagccagttttatttggcaactttatgcacaaaatttacctgcaacggcattagagaacccttttgataaagattcaatgatgtggcgtttaatgcgcttaatcccaatttttcttgagaaagaaaatttttcgcctctacgtaattatttatcatcttcgccacattctgaacaatataaactttatcaactcagcagtaaaatagccgacttatttgaccaatatttagtttatcgacctgaatggatttttgcttgggaaaaaggcgaagatgaacaaatcactgatcaaatacaaaaacaacaacctaacctaaacgcaactttgtttgcgcaaattcaaggcaatacaaaatggcaaggtgagttatggcgtgcgttggtcgtcgatgttaaatcagatgttaatgaagccacccatcgagcagctttgcataatcaattcttagccttgcttgccgataaaaaagcaccgaaaaaattaccttcacgcatatttatttttggtattcctgcgcttccaactgcttatctcaatattttgcaagcgatatcctctgaagtggatattcatttattttttaataatccttgccaagaatattggggggatattagtgatttacgccttgattatttgcgttctcgtcagcgttatcaattcaataaacaagatgaaaatcaaccgctcttttccgaggatcaactttctcaactagaaaacgctcagtttgacgtcacttatcaaaaagaaaaccttcaactaggcaatccattactggcggcttggggaaaaatgggacgagattttctctatatattggtgagagatgaagaacatattccaacttatcccgtcaatgcctatcaagaaattgagtcaaacagtttactcggacaattacagtctcaaattctgcatttagaaaataaaccgttaaatatcgcaaaaaatgaccgcactttaaccctacattcttgccacagtgctatgcgagaagtggaagtattgcacgactatttactggatttattcaatcaagatcctagtcttacgccaaaagatgtggttgttatggtggcagatattaaccaatacacaccctatattcaggcagttttcgggcaaaaaaatggggatgtgccacaaattccattttcactttcggataataaactttcagaaagcgatgtgttggtatcaagttacttaactttattacgcttaaaagaaagcaattttagtgcagaagatgtcttggtattgttggatattcctgcgatgcgagaacgatttaatatttcccttgctgatttaccattagtgcgagaatgggtaacggattcagggattcgtttcggtttgcaaaaaaatcaagatggcatcaatttcaattcttggcaggctggattagaacgaatgattttaggctatgcgatgcgtgaagaacagggcatttggcaagatagtctgggcttaaacagcagttatggcttaaagggcgagcttgctggaaatttatctcactttttcaccgcactttccgcgctgcatgaaacgctgcaacaagcacattccatcgaaaaatggcaagaaattttaaccgcacttttatcggatttcttcgtgcgaaatgaagacacaagcgacatgattttctatattcaagagaaaattaatgaattagctgagcatctaaaaacgctccattttaatgaagaattacaagcagaagtgatcgccgatgtcatcacaatgcaattggaagatgcgccaaatagcctcaaattccttgcaggaaaagtaaatttctgcaccttattaccaatgcgttcagtgccattcaaagtggtttgtttacttggaatgaatgatgcggattacccaagaacacaaacaccaaacagttttgatttaatgcaatatcattatcaaaaaggcgatcgtgttcgccgtgatgatgatcgctatttgttcttagaagccttattggccgcacgtgattattgctatatcagctatgttgggcgttccattacagataatcaaccgaaagaaccatccgtattggtaagtcaactgttggattatattaatcaagggcaaaaggaaaatgtccttactgtcattgaacatccaatgaccgcatttagcccagataatttcaaaaacaacgaaaaatttacccgctcttttgcgacaaaatggttgccaatagcacaatttgacgcgagttccaacaattcagaatttgccgtcactatgacagaaaacctagaaaaaatcgaagaagttgaactggatgctttagtcagctttgtggaaaatccagtgaaatttttctttgaaaaacaactcggtgtttatttccgcgataaagatgaacgcattgctgacagtgaaaacttcactttaagtgggttagataattattctctcaataatgacttaatttaccttgatgaacaaaattttgctgattattttagacaagcagaagtaaaaggcgtgttaccgcgcgcagagtttggaaaggtttatgctgaaaatattcgcgacaatgttttagaatttaaaaagaaaatagcagatcttggcgaagccaaacatgcttctgtcgattttaatctctccgtagattggcaaaacgaaaatcaaaaaatacgtttatttggttatatggacgctttatttggcgatgattcacaagtcattcactggcattttgctaaatataaagatcgttattgtattcgtccttggatttattatttaattcaatgtgttacacaagaaaatgcggtaccagcaaaattaattacgcaagataaggttctcgaattaccgcctattgagcgtgaagttgcacttgctcaattacaaatttacgtaaaagattatttacaaagtcaaattgaaatccaattggtgccaacagtaagaaatataagtgattttattgtaagtgatgaaaattccgtttctgaaaaacttcaggaattaactgaaagtaatggtttcgggccaaaagccgatccatattggtcacgagtattagcgcagacctcaagatttaaacaacctgaaaatattgcaaaattattaaaacaaacaaaagcttggtttggcttattattcgcacaaaagaagacaagaaagacacaaagctaatcgtcaaataacctattttttagtagaataacacccttttatggagaattatctatgcactgtccattttgtgatacagaagaaactaaagtcattgatagccgtttagtatctgatggttatcaagttcgccgccgccgtgagtgcggtcattgtcatgaacgttttactacttttgaaatggcggaattaatcataccgaaaattatcaaaactgatggtacacgtgagccattcaatgaagataaattgcgcaggcggtattcaacacgccttagaaaaacgtcctgtaagtgcagatgatgtagaaaaagcaattaatcacataattcttcaactgcgtgcaactggagaacgtgaagtgccaagtaagttagtgggtaaacttgcgatgaatgaattaaaaaaactcgataaagtggcttatattcgttttgcatcagtctatttaagttttgatgatattgatcaatttactatcgaaattgaaaaattaaaggattaattatgcttgaattttcctcacaagattgcgtatttatgcaacgtgccttagatttggcagccaaaggtcaatataccactacaccgaacccatcggtgggatgcgtattggttaaaaatggtgaaattgtgggggagggctttcattttaaggcaggacaacctcatgctgaacgcgttgccttagctcaagctggtgaaaatgctaaaggagcaaccgcttacgtcaccttagagccttgcgctcattatggtcgcacaccaccttgtgcattaggattaattgaggcgggcgtagtgaaagtcattgcggctatgcaagatccaaatcctcaagtcgcaggaaaaggtttgaaaatgttgtctgatgccggtatcgaaagtacggtgaatttattgaacgatcaagcggaaaaaataaataaaggttttttaaaacgaatgcgtcaaggtatgccttttgttcaactaaaacttgccatgagtttagatggacgaactgcaatggcaagtggagaaagtaaatggattacgggcccagatgctcgttcggacgtacaaaaaatgcgagcaaaatcatccgcacttttatctacttccacaacagtcattgcagatgatccaagccttaatgtacgctgggacgaatttcctgaaaatcttaaaacagaatataaaaaagaatggcttcgccagcctgtgcgagtcattttagattcacaacatcgcattcagccgactcataaactttttttaacccattctcccgtttggttagtctctagtgagccacgagatttaacaggctttcctgatttttgtgaacaaattatttttccgaaagaaaatttactaaaagaattaatgcgagaactgggaaaacgacaaatcaataccctttgggtagaagctggagcaaatttatcgggcagtttaattgatgcgaaattagtggatgaattgattatttacattgcgccaaaattacttggagacaatgctcgtggtctatgccaattaccgaatttaactaaacttgctgatgcaccattatggcaactcaatgaattagaacaaatcggtgacgatataaaattaacttacacaccgaaaggagtctaaatgcttaaaaaacttttccattccgcactttggggcttggctgctgcgggcgtgattttgtttgcggttccaagactgaataacagcaatatcttcacttcagacgatattatatcgttcaaaaatgctgtgcgtattgcctctccagcagtagtgaatgtttataaccgctctttttcttccgccagcattaatgataatgatcagctacaagtgaataacttaggttctggtgtgattatgagtaaagatggctatattctgacgaataaacacctcatccaaaatgcagatcaaattgtagtagcgttgcaaaatggaaatatttttgaggccagtcttgttggttcagatgatctcactgatctcgctgttcttaaaattcgtgcagataatctttcaactattccacaaaattcagcgcgtcaagctcacgtcggcgatgtggtattagcaatcggtaatccctacaacttaggacaaagcgtgtctcaaggaatcattagcgcaatcggtcgtaatgcggtaggcgattcggtgggcagacaaaattttattcaaactgatgcttcaattaatcgcggaaactcaggcggtgccttaattaactctgctggggaattggttggaattagcacgctaagtattggcaaaaccgccaatgaaatcgcagaaggactaaattttgccattccaatagatattgcaaatgatgtactacgtaaaattatgcgtgatggacgtgtgattcgaggttattttggtgtacaaagtgatattagttcaagtagtgaagaaggcatagttatcacagatgtaagtccgaacagcccagctgcgaaatcaggtattcaagttggcgatgtgattttgaaattaaataatcaagaaggtatttcagcccgagaaatgatgcaaattatcgcaaatacaaaacctaattcaaaagttctcgtcaccattctacgattaggcaaaatcttacaaattccagttgttattgaagaatttccagtaaattaaaaatagcggtctattttgaccgctgttttcattatatttaatactttcttttcaatttgaaaatttatttgttctaaccccttttctgacatttcgggcaaaagaaactattacgctgtccaataattaaactttcaatttttccaccgcactttggacaaggtttatctttattgccatataccaataattcttgtgcaaaataacctgggcgaccatcgggctgtaaaaaatctttaagtgttgttccaccttgaataatggcttttctcaaaacatctttaatcgtgttcactaaagagaaacattgattgcgagtcaaatttttagcgagtttaaggggatgaatgccacaaataaacaaactttcattcgtataaatatttccaacgcccactaccacagcgttatccatcaagaaagttttaagtgcggttgatttttgacgagattttttgaataaatattctgcattaaattcatcagaaagtggttcagggcctaactttaagaaaagatgaaagtcatctagattctccgtccacaaccatgcaccgaaacggcgaggatcgttatagcgtaataacttgccattattcactacaatatcaatatgatcatgtttatctattgcactatcctgtggcacaattcgcaccgaacctgacatgcccaaatgcccgatgatatagcctttttccgtgtgaataatcaaatattttgctcgacgagtgagatcgacaatttttacattttttagcgttatcaattcctctgatacagcccagcgcaatttaggctggcgcacgacaactttctcaatcgtaaaattcttaagataagggctaataccacgtagtgcagtttcgacttcaggaagttctggcataattttcaacttagtaagtagatagaataatgatataaagtgcggttagttttaccatttttttatattctttgaaaattaaaatgatgaatatttcaaaaatataggtagttatctaatggataaaatttatatatctcgtttgatctatgctaaaagatttttattttacagaataaccgcctgttttcagatacaagcggttatttttttgtgttaattgactaactaattaatcaatgggtggtgtgtaagtgccatttttgatgtcgtctttaatacgatttgcttctgttagtacttgagttaataacgctttaacattttccaatgttgcaatcgggcttagggtagtcattttcagcgattgtttgtcgcctactttagtcacgccaatattcgcttctcctcgagcaaagagttcatctgccacgttttggtttagtgcatcaataaattcagctggatagtcttttggtacgacacggaataacaccgatgcaaactgacttggcacaagcatttctaagtcaggggtatcgttgatgtattgctcgacttctttggtcagttttacgccgtgatcgatcattgaagcgtaaagatcttcgcccaatgcttcaagggtaaaccataattttaatgcgtcgaaacgacgtgtggtttgtaatgatttcgccactaagtttggcacgccgtgagcttcatcatattccgaattgagataatccgctttgtaatcgataaagcgatagttctctggatccttgagtaaaaatgcaccacaggaaatggtttggaagaagtgtttgtggaaatcaagcgtgatggaatcagttaattcaataccatctaagaaatagcgataatctttggaaagcaataatgcgccaccccaagcggcatcaacgtgtaaccacgcttgatattcatcggcaagtttgcggattgcttttaagtcatcaattgcgccagcatctgttgtgcctgcggtagcaacaatacaggcagtaattttgccatcagctttaagctgtgcaagtgtttgtttaagtgcaataagatccatttgtgcattggcatttgatggcacagtaacgactgattggaaacccattcccatcattgccatatttttttgtacagagaaatgtgcgttttctgaacaaatcactttcactttttgcatcgcttctgctggaataccatcacgttgtactgaccattcagagccgtcttcgtttttccagtggtttgcaatcgcccaatcgcgtgccaacaatacgcccattaagttagattgagtaccaccagaagtgaacacgcctgatgtgccttcgccatagcctgctttttggcgtagccagttgatcaaatgctcctccataattgaacctgctgggctttgatcccaagaatccattgattggttggtcgcattaatcagtacttccgcaatttggcttgttaccatcgttgggcaatgtaaatgggcaagtgagtgtggatgatgtactttaaggcttggattaaggaaaatttctaccaaatgatcgagtgatttctgtacacccataccctctttcgtcggattaaaaccgcttattaaggctcgcatttgtttgattgaaccgcctgtgtacattttttcatttttcagccaagcagagactgcttgcaccgcattatgcatcgctgtttcataatcgttaatggcttcgttatcgttgcaaaacaaagcttgtttgtgttgtttgaggtttgacataattattcctagatatgaattacacccaattttctgtacgtaatgctataactcgctcaaattctcttaaattgttactaaccagaattaacccttcactacgagcatgagccgctatatgaatatcattttcgccaatcaatttcccttgtttagagagttcagctttaatattgccgaaatgagctgcatgctttggttggtaatctaaaatggtgaggcgtgataagaaatcttcaataaccgcaatgtttctttcgggatattcgcttttttcagctccataatagagttcagccacagtaatgctactcacgcacatttttcctgcattttgattaaagcgagaaagaatttccaatggcctacgcttaatcacgtaaatcacaatgttagtatcaagcatatatttcaacactataaagcctcacgctctggttgaaatgcaatttctcgttcattcataaaatcatcgctaactgcttgatcattcaagaaaaaactatcccaagattggttgagaggcgataaaatccgatcactgcccgatacacgaaccgataattttttgatttcttcagaaaagcgaacttcagcgggcaaacgcacagcttgacttcgattagtcataaaaacagaggcttcaatcatagttattccttatgcttaattgtatatagcataagtatatcccagttttatacagttgagtagaaaaaaggtgggatttccctaccattttgaatttacaagcggtcaaaattcgcaaaacatttgcaaaatcagaccgcttttaattaactacgcaccactttcaatgcgtctacaacagattgtttgaagcgtttgatgaactcttcacattcactttggttgatgtttaccgcacaaagcacgcgaaccacgttgccaccgcgtccgccacgttcgagcaagagtttgtttttgaagcaagctttttggattgctgccgctaattcacaatcgcgtgggtaagcccctgtcgcatctttcgattggcgttcgtctacaatatcgatccccatcattaagccacgaccacgtacgttgccgatgcacggatattctttgcttaattcacgtaatgcgttggttaagtattcaccacgctcttgggcattttgtgcgaggttttcatcacgcataattttaagtgaagcatagcctgtcgccatcgctaattgattgccacgaaatgtacctgtatgtcctgcaggttgccaagcatcaaattctttacgaatagctaatacagctaatggtaagctgccaccaactgcttttgacatcacaataatatcaggctcaatgcctgcgtgttcaaaggcgaacattcttccagaacggcagaaaccagcttgcacttcatcgacgatcattaaaatgccgtgtttttgggttacttcacgtactttttgtaagaagcttattggtgctgaaacaacgccgccttctccttggattgcttctaaaattactgcagctggttttactacgccactttctacatcttcgatgaagttttcaaagtattgttcaactgctttcgcacccgcttcgccaccaatgccaaatgggcagcggtattcgtgtggatatggcataaattgtacgccaggcattaaattttcaacggcattttttgcaccaagattacccgttaaggctaatgccccttgggtcataccgtgaaaaccgccagagaaagcaatgatattgccacgccctgtgtaagttttcgctaatttgatggctgcttcatttgcatctgcaccagaagggcctgtgaattgtaagatatatttatctttcgggaagaatgacaataattcttcactaaacgcatctttaagtggagtggttaaatctaaagtgtgtaacggcaatccgctatctaatacgtctttaatggcttgcattaatataggatgattatgtcctaatgcaagggttcctgcgcctgctaaaaagtctaggtattcattaccttcaacatcagtaacccaacagccttgtgcttttgcataggcaaaaggtaatttacgaggataactacgtacgttggattccattacatcttggcgatctaaaaaatgttggtttgaagcaagaattgcttgtacaggggtaatcattgtcatttttgattaaaaccttctaaaagaggtgaaaaaaaataagtcgggtgccttgcgataaatttactgtttataaaacagacacatagggcatttgactcgctacttattaaaaaaagcgtttcagcttttttgtttttaccctagtttgcccattggacgggctaggttggaaacaggttttgatgtagggttacgtcaaaacggggacaattgtatattttttttgcaatatgaaaagtaaatttagcttcttacgagtcaaacggctaaataaaaagcaaacgtttctaataagaacaaataaaaaacccgagtttctactcgggtttaaaataattaaatcaatattatttgatttttgcttctttatagataacgtgtttacgcactactggatcaaattttttgatttccattttttcaggcatattacgtttgtttttatcagttgtgtagaagtgacctgtctctgcagtagaaactaaacggattttctcacgagcgcctttagctgccattttttagctccttagattttttcgccacgagcacggatttcagctaatactgcatcaatgccttttttatcaataatacgcatacctttcgcagttaaacgtaaggttacgaaacggttttcactttcaacccaaaaacggtgagtgtgaaggtttggaagaaaacgacgacgtgtcgcattcattgcgtgtgagcggttattacccacagctggacgcttgcctgttacttgacaaactctagacataataatctccaataattaaatataagctcgagcttacggttcggattgtttaaagctggttaaacctagcttgctacctcgtcaggtcgcgctaatccgacccgcttactatattaaaggtcgcaaattatactgactttgttttcatttctcaagtgtaaatgcgattttcctgaatgtaatcggtaaaaaaatggtcaatattataaaaatttataataaacaattctccgcgaaagaataacaatcgcttttccctacaattaaatgatcaagcacgcgaatttccattagttcagccgcatcttgaatttttttagtaataagctgatccgaataactcggctccgttatacctgaaggatgattatgtgccaaaattaaagctgccgcattacaatagagtgcttctttaataatttctcgcggatagaccgctgatacataaattgtacctaaaaataaccgctcttttttaatcaaacgatgttgattatctaaaaataaaaccataaatacttctctttcctcgtgttgcaattcagtgagtaaaaaaagttttactgtttcaggatcattaataatcggcgtacttaacatatcttgctttaaataacgcttggtcatttccgtaatcgcttgcagttgaataaattgcgtaatacctaagccttttacagaacagaaagcttttttatctgcagaaagtaaagcgtgcaaggggccaaaatgcgttaatacatttttagaaagtgacataacaggacaacctttgataccagtacgtaaaaaaatcgcaagtagttcataatcacttaatgcttttgctccaaatgccagcaatttttcccgtggcattaattcatcattgttttccatatatttataaaagaaaaataagaaagattttgaccgcactttttaggtttgacgagcaagtgattcaaaatctgcgatgcatatcgtaaaaatagcgttgggcattcaataaaattaaagtaaaataacgaaattgtggataagtactaacaaaggttaaaacatgaaattaaacggaaagcatattgtagttggcataactggcggtattgcagcctataaaacaatagagttgattcgtttgttacgcaaagcagaagctgaagtacgtgtagtattaacccctgctgcggcagaatttgttacgcctttgacacttcaagccatttctggcaatgctgtatcgcaatctttacttgatccacaagcagagctggcaatggggcatattgaacttgccaaatgggctgatgccattattattgcgccagctagtgcagattttatcgcccgtcttactattggcatggcgaatgatttactttcaacaatttgtcttgcgactaatgcgccaatttttcttgcgccagcaatgaatcagcagatgtatcaccaatccattactcaacaaaatttaacgactcttcaaacacgtgggattgagcttatcggccccaatagtggttttcaagcttgcggcgatatggggaaagggcgtatgtcagaaccagaggaaatttttaccgcactttctgactttttctctcaaaaacaagatctacaaggattaaatgtttccattacagcaggcccaacgcgtgaggcaatcgatcctgttcgttatatttctaaccatagttcagggaaaatggggtttgcgattgctgaagcatttgccaaacgaggggcgaacgtcacgctgattgcagggccagtgaatttaacaacaccaaaaaatgtaaatcgaattaatgtcatctcagcacaagaaatgtggcaagcctctcttgaaagtgcggtaaaaaatcaaatttttattggttgtgcggctgttgctgattacagagtaactgaagttgctgagcaaaaaatcaaaaaatctggcgatgaaatatctatcaaattaattaaaaatcctgatattatctcagatgtaggacatttaaaaacacatcgtccctttactgttggatttgcggctgaaacccaaaatgttgatgattatgcaaaagataaacttgaacgcaaaaatcttgatatgatttgtgccaacgatgtatctggcggacaagtttttaacgctgatgaaaatgccttgcagcttttttggaaaaatggtcataaaaaattatcgctaaaatcaaaagtagaacttgccgctgatttagtcaatgaaatcatcgaacgctatcaaaaaaccttataattccaaccgtacttttacctaaaaatgaatttcaaacggagtattaaatgaaaaaaattgacgtaaaaattttagattctcgcattggtaatgaatttcctttgccaacttatgcaactgaaggttcagcaggccttgatttacgtgcgttgatcgatgaaagctttgaaattcaaccaggcgaaaccaaattaattccgacagggctatcaatttatattgcggatcccaatttagctgccgtgattttgcctcgctcgggtcttggccataaacacggcattgtgttaggaaaccttgtgggattaattgactccgattatcaagggccattaatggtatcaatgtggaaccgtggaaatgaaccattcaaaattgaagtcggcgatcgtattgctcaacttgttttcgtgccagtagtacaagctgaatttaatattgtagaagattttcaacaaaccgaacgtggagaaggcggtttcggtcattcaggtaaacaataatttatggtagaagaacaattatctttatcaggcgtagaagaaattgcgcctaaaattgaaacaccgaaaattgaaaaaagaacggtaaaagaacgtcgtcagcaagtgcttacagtattgatacatatgcttcattctgaacgtggaatggaaagaatgacaaccgctcgtctagcaaaagaagttggtgtgtcggaagctgcgttatatcgttactttccaagcaaaacaaaaatgtttgaagcactaattgaacatattgaaagtactttgctgagccgaattacagcatcaatgcgtaacgaaactcaaacaatgaatcgcattcacgacattttacaaacaattttggattttgcccgaaaaaatcccggcttaacacgtgttctaacaggtcacgcgttaatgtttgaagaagcgcaattacaagcacgtgtggcacaatttttcgatcgtcttgagatgcagtttgtcaatattttgcaaatgcgtaaattacgtgaagggcgtgctttcaacgtggatgaacgtataattgcctcacatttagtgacactctgcgaaggacaatttatgcgctatgttcgtacaaatttccgtctgaattcaagtcagtcttttgaacaacaatggcgttttatcgagccactttttgcctaattgactttaccgagtaaatatatgattattccttggcaagaactagaagcagaaacattagataatatcgtagaaagcgtgattttacgcgaaggaaccgattacggtatagaagaactttcactcaaccaggaaaaaacaacttttactgactcaaattcgcaatggaattgcgttgattgtatggtctgaattacatgaatccattgacatcaaaaataaaacggaatttttgaaacaggaatgtaaggagcaagaatgtcaaatgaattaaccgaaattgatgaagttgtaacctcctctcaagaagaagcaactcaacgagatcccgttttagattggtttcttactcactgccatttgcataaatatcctgcaaaatcaactttaattcatgctggggaagatgcgaccacgctgtattatgtaattaaaggttctgtaatggtatcttcaaaagatgatgaaggcaaagagatgatcctcacttacttaggtgcaggacaattttttggcgaagcgggattatttgatgaaggttcaaaacgatcagcttgggtaaaaacaaaaacaacatgtgaaattgctgaaatttcctataagaaatatcgccagttgattcaggcaaaccctgaaatcttaatgtttctcactgcacaattggcaagacgtttgcaaaatacatcacgtcaagtcacgaatttggcatttttagacgtcgcaggtcgcatcgctcaaactttaatgaacttagctaaacagcctgaagcaatgacgcatcctgatggtatgcaaatcaaaattacacgccaagaaatagggcaaatggtgggttgttcacgagaaactgtggggcgcattattaagatgttggaggatcagaatcttatccacgctcatggaaaaacaatcgttgtatatggcgcaagataatttttcatcataatttattcaaaataaaaccatccgaaattaatttgggtggtttttgtttaattggaaataatattcaaaacattaattgacaattaatataaaggattttatcattgctccacttcttatggatattgtaggaagacaggattggtctcctgatatagtggctttaaaggtttaaaccttattgcatagttttatgctgcaaaagctagaacaccgagatgcattttttaatctatggtgggctgggtagaaatcccgcagggatgcgtgcagtaagccacttgctgttaagaccaattctgcttagttccaccacccttctttcaaattccctagccttttctagcttaccttaattaatcttttttctttctagtaaaactaatacttcatagtgagatgtttgcggaaacatatcaaaaagttgaattttcaatggtttataacaagttagatgctgtaaatctttacccattgtcatggcattacagctggaatacaagataaagtgcggttgaatttggttgagaaattcacttaattcctttccaattccacgacgcggcggatttacaatcacaagatctggcttattttcatttttattttcaatcacgcttgctgcatctagagattggaaatttacatgttctaaacctaatattttcgcagaatgactggctgccaaaatagcagaggaagaaatttcaattcctgttaatttaatgggttttccccatttttcctgcaacgctttagcacaatgtaagccaaatccccctacgccacaaaataaatcccacaagttataaatagggaattcagccacccattgttgagcggttgcatataaacctgcagccactttagggttagtttgaaagaagcctcgtggacgaataaagagcggaataccgttaaaattttcaggcaaaaattgttgttctgtcagaaaaatttcttgttcgccctctaaaatagccgcgtgctgtggttgtaaattaatactaatcacttctaagtgcggtaatttttccaataatttgggcaattctcgacgaattaatggtaatttattttctgtacgtaacacaaaacgcaacatcaatttttccgtcgcgatactttctgtcagcaaaatatatttaagctcgcctttttgtttagcaatgttataaggtactaaacctgcgcgaccaataaaatctttgagaattgaaaaaattgctgaaaaatgtgtaggataaagaggacaatcacacaaatcaatcgcactttgtggatcattaggattttttaaaatgccaagtattgggcgttcaacactaccactaacaaccattttagctttattacgaaagccttgttgattagattgaaaaggagccacccattgagcttcatcgtaattaatagaaatcagttgctgctttaaatgatattgtttttcagttagctgctgactacaaggtatttcaagccattggcaagaacgacattcattttgttgatagtatcgacaatcaatcattttttgctgcctgaatgtctaaccaacggctttgaatatcagctaatttttgataattaagtctccaacgttgatctgaaattaagtcgttccaattaatcactctacgtttaaataaactttgtaagcgagcttgacgagccataaagtgcggttgattttcagtaagttttagattatctaatacttgaatgacaccttcacgttcattacacagtaataaaagatcgcaacctgcattgagtgcttttttactacgctctacaaaattccccattactcccgcgcctttcattcctagatcatcggaaaaaattgtaccttggaaatttaatttcttgcgtaaaatttctttcaaccaatattttgaaccacttgcaggctgactatcacattgcgaataaatcacgtgagcaggcataatcgcatcgagtttattctgtgaaatcaactgttggaaaggttggagatcgccactaaaaatttcttcttttgtacgatcatcataaggcgtttctaaatgagaatcggctaatacatgaccatgaccgggaaaatgtttacctgtagatgccatacctgcttgatgcataccatcaataaaagcggtggctaaatttaccgcactttttacatcagatgaaaaactgcgatcaccaatcgctcgacattcatgccccaaatccaacacaggagcaaaactcaagtcaatatccaaggcaatcatttctgctgccatttgccaacctgcttctttagcaaaactcacttgttcagttgctgacagtgtttcttgaaaagcctgcattgaaggcaacattgtaaatccatcacggaaacgttgaactcgtccaccttcttgatccaccgtaattaataaaggctttttcactcgttggcgaacagaacgaattaattcttgaatttgttctctgttttcaaaatttcgagtaaataaaattaatcctgcaacaagagggtgagaaagtaactcaacttcctcttgttccaactcttttccttttaaatcaattaacaacgagctcataaattattttaaataaaggcgataatttttactttctacagtaggtttagttaaatcaattgatttttgctcttgtggttttagcaaaaattgagcggaatagctttcttgctgattttcccaaatttgggttacccctaaatgatcgtaccaatacaaatggtaacttatattcaaaagttgctgacttttattttttataaccgctgatttttgagtcgtttcaacttgaatcaaaggcgaaagagacgacgtaatattcaaaatcggctttgttgaataagttaagttttgttctgaacttgaacaagccacgagcataaagctcgctaaaattagaaaatattttttcattatttcgctaacattctacctaaaggttctccaccaactaaatgcatatgtaaatggaatacttcttgcccaccatgtttattacaattcacaattaggcggtaaccatcttccgcaacaccttcttctttagcgagtttagccgctacgctaaataatcgacctagcgctacttcatcttgctccgtcacatcattcactgtgggaatgactttatttggaataatcaaaatatgtgttttagcttgaggggaaatatcacgaaatgcagtgactaattcatcttgatagacgatatttgccggaatttctttacggataattttactaaaaattgtttcttctgccattgtttgctccctataaaaagtgcggcgaattaacctgtccataattgttgcttatttagtctaacttttaaggacagagcaaatcaatcgcactttttgttttacaatgaatttaattatgcaaagtatcgaacttctccattgcccactacattttctacacaacgagcacaaagtgttggatgttctgggcttaccccaatttcgtcagaataatgccagcaacgagggcatttttctgcgttagaacgtgttacgcttaccgcaataccctctaattcgctgtccgctaaatcagcaggtttttccgataaagattttacatctacttttgaggtaattaatacaaaacgtaattcattgcctaattgtgctaataatgcacgatattcgtcattagcataaacggtcacttctgcttctaaaccgccgcctatttctttattgttacgagaaatttctaatacgcggttcacttctgaacgaactttaatcagttgttgccagtaagcatcatctaatttttcatcctcgcctaaaccaaataagccttgatagaattcttcagtaaatacgaattccgcacgagcactttcagtttgtggcaagtgttgccaaatttcatcggcagtgaaagataagatcggtgccatccaacgaactaatgcttcagcaatatgccataacgcagtttggcaactacgacgcgcaaggctgtctgctttggttgtatattgacggtctttgataatatctaaatagaatgaccccatttctaccgaacagaaacgcattaaacgttgtaccacagtgtggaattgatagttatcgtatgcatctttaatttcattttgtgcatctaatgcacaagctaccgcccaacgatctaggctaatcattttttctggtttgactaaatcacgttttggatcaaaaccattcaagtttgctaataagaaacgagcggtgttacgaatacgacgatagctgtccgctgcacgttttaagatctcatcagaaacggtcatttcacccgtataatcagtagaagcaacccataaacgtaaaatgtcgccaccgaatttatccattacttcttgtggtgtcacgatgttaccgatagattttgacatcttacggccttgaccatccacagtgaaaccatgagttaatacttgcttgtatggtgctttgctgtctgttgcggtagaaagcattaaagaagacataaaccaaccacggtgttggtcggaaccttccaaatacatatcaatatcttgaccgttaaattctaggcgatttgcaacaacagaagaataggttgatcctgagtcaaaccatacatcaagggtatccggcactttgcgataggtttctgcgtccgcacctaataattctttttcgtctaaatcccaccacgcttgaatacccgctctttctacacgtttcgccacttcttcaagtagatccaaggtacgcggatgaagttcttcggtttctttatgcacgaacaacgtcatcggcacaccccaagtacgttggcgtgaaatacaccagtctgggcggttttcaaccattttctcaatacgtgcttgaccccaatctggaatccagcgaacttgtttaatttcgcctaatgcttgttggcgtaaaccttgcgtttccatgccgataaaccattgcggtgttgcacggaaaataattggcgttttgtgacgccagcagtgtggatagctgtgtttgattttttcaacttttaataagttacctacttcttgtaatttttctatcacaagcggatttgcttcaaatacgcctttgcctgcaaagaattcggtcgttgaaataaatttaccatcattcgatacaagacccgccattggtaaatcatattgtttacccacgataaagtcgtctaaaccgtgatcaggtgcggtatgtactaaacctgtaccgccatcagtggttacgtgatcgcctaaaatcactggcacagtaaaatcatagaacggatgatggaaacggcttaattcaagatcatcaccttttacagaacccagaatttcaatgtgctcaatacccaccgcttttgccactgactcaactaattcagcagctaaaattacacgctcatcgccaagttggactaagttgtattctaagtctgcattcaccgcaatcgcacggttagatggcatcgtccaaggtgtggtagtccaaatgatggctgataatttaccttgtcctctaccttgtgcagaaaatttagcttcaatttcatccgcactttccgcagggaaacgaacgtaaattgacggagaaactttgtcttcatattccacttctgcttctgctaaagaagaaccgcaatccaaacaccagtgaactggttttgagcctttatacaaatgaccattttcaatcactttacctaaagtgcggataatattcgcttcggtatcgaaattcatcgtgagatatggattatcccaatcgcccaacacacctaaacggataaagtctttcttttgaccctcgacctgttccgccgcgtattcacgacatttttgacgaaattctgccgcagaaattttctcgtttggtttacccactaaaccttctacttttaattcaattggcaagccgtggcagtcccaacctgggatataaggcgaatcaaaacctaacgccgttttggatttaataataatatctttcagaatcttgtttacagcgtgaccaatatgaatgttaccattcgcatacggagggccatcgtgcagaataaaagattttttgcccttactcgctttacgaattttttggtaaagatttttctcgtaccaatttttcaacatatcaggttcgcgcttagctaaatcaccgcgcattggaaagctggtttccggtaggttaagagtgtttttgtaatcgactgtcattttattttccaatttttacattttaaaattaactgttaaaaaacgctttcgcagtttctacatctttctcaatttgcactttcaaatcatcaaaagaggggaatttaatctcgtttctaatcttgtggcagaattccacttccaccatttggccataaatattctgagaaaaatcaaataaatggacttctaataattgcattaatccatttatagttgggcgttttcccatgtttgccacgccgttaaaaatctcccccgattttaaccgcacttttacggcataaacgcctttgattggatttacttgtctatgcaaacgaatatttgccgttggaaatcctattgttctgcctaatttattcccatgaatcacacgcccgaaaatacgataaggtttaccgagtaaattttctgcaagttgtaagtcatcattcgctaacgcttcgcgaattgccgtgctactaattcgctgtgcatctagacaaaaactacggttatcttcaacaataaaaccaaaacgcttactagctgcttgcaacatggcaaaattaccttggcgttttgagccgaatttgaaatcatcgccaatgcttaaaaatttcacatgtagatgattaacaagcgtttgttcaataaaaacatcggctagttgctcggcaaaagtgcggtcaaatttcgccacaattacgacatcgaccttagccttttcgagataataaattttgtcacgcaaacgcattaaacgggctggtgcatttttccccataaaatattcacgaggctgtgattcaaataacaataccgccatgggtaaatttaattcgtcagctttttgacgcaaatggcgaaggacggtttgatgccctaaatgcacgccatcaaagttgccgatcgttagcgcacaaccttgtaaaacacgatttgcattgtgaagcccgcgaattaattgcatgtccttatccatgaaaataagagaatttcggcattatagcgagaagttagttttttgtcagcaaatggtgcttgcgaacgcctaataaaatcaacgttgcaccataaactattgcggctaatacaatcaaccaaacaagccaataaacacgcataaagaaatccattttcgcccattggttgatttcaggcacgtaataccaaactgccgcacccattgcgattgccgccaataaaactttgacaaaaaagaccgcacttttacgtgaaaaatggtacacatccgctttggctaagccgcgatagagtaaataagcattaagggttgcggacatcgctgaagcaatagctaatcctacatagctgaaaggaatcgccaatagattaaagcccatattactcaccatggcaataatgccaatttttactggcgttttggtatcttggcgagcgtaatagccattggcgaggattttaatcaacataaagctaagcaaacccgcattaaacgcccgtaaagaataagaggcggcataaacatcatttagcataaaatttccacgcataaagagcgtaagtaacatcggttgagccaatacagcaataccaatggctgcaggaacgccaagtaagaaaatcattcgcacgccccaatccattgtattacgaaaatcaaccgcacttttagctgaatcgccttcacgattaacgtggtggcgagcaagcgttggtaaaattacggtagaaatcgcaatgccaaataaaccaagaggaaattccagtaagcggtcggaataatacaaccagctaatagagcccgtcattaagaagctcgcaatcactgtatccagcaaaagattaatttgacttaccgatacaccaaataacgcagggatcattaatttacgaattttggttacgccttcatccctccacgcccattttggtttcaccagcaaacctgcttgtttcataaatggaatttggaataagaactgtaataagccgccaagaaaaattccgatagcgagcgcaagatctgggttatccatttgtggtgcgaggaaaagtgcggtggcaatcatcgctatatttaataacacgggtgaaaaggacatcacaccgaattttccaatcgtgttaagcacagcgccagaaaatgccacaaaagtnacaaaccataaataaggaaaagttattttaagaagaagagaggcttgttcaaacttatgtgcatcagggccatcattcatccaatcggtgaaccagcccatcccaaataaagcggcaacssacagcgaaccaaccatcgccaaaatcgtnacaatactcaccaatcccccaagggtaccagaaacttttccaataaattcacgggttttattcatatcgccagattgttgatattctgcgagnacagggacaaaagcctgtgaaaaagccccttcagcaaataaacggcgaagnaaatttgggatacgattagcaaataaaaagacgtccgctgcggcgcctgccccaatgagatgagcgataactacatctcgcacaagacctaacactcttgataataaagtcatagaactaacaacaatgctagattttaaaagtcgtttactcaaaatattcttctctaccctaaaatttttgcctaattgtatagaaattttgtttttacgctatattccgtgaaaaaaaactgataaaatccgccacacatcgtttgtgtgagcccatattgaaagagcttgtaaaaataacgatacttactttcggttgtgtctcaccgaaatcaacacaaattttccattgacaaaagtataaaaaatcggcatattgatgccctttattttgtctatcaatcaacagaaattttaggagtttgaccttggctaatatcaagtcagcaaaaaaacgcgcggttcaatctgaaaaacgtcgccaacacaacgcaagccaacgctctatgatgcgtacttatatcaaaaaagtatatgctcaagtagcagcaggcgaaaaatcagcagctgaagcagcattcgttgaaatgcaaaaagttgtagaccgtatggcttctaaaggcttaatccacgctaacaaagcagcaaaccacaaatctaaattagctgcacaaatcaaaaaattagcgtaatttttagctagaaagaatgaaaaaataaaaccgcactttaaagtgcggttttttattgcatcgaatgttagactaaagtaacaacatcgatccccatttgataatatcaaagaagaatttattttgattggttgcaatgccatcagaattttttggtgtgccatcttcatttttttgcacttccaccatgccatttttatattgacctttcacggcagccaaatcatcgcgcgcttcgttacgcaatttcaaacaagactgtttagttaagggttcaacattgctcactctggtacggaattttttaaactgatagcttgcataattcattgatttttcatcggcttggataatcttcacatattgttcgccaataattttttccaacggatagaaaaagacatattgtgagtgaatatagctatcttcttttgaaaaatgctgttgcaaaattcgagttaaatttgggtaaacgcattgttctacttgcttacttgcaatcgcccattgttttgcatgttgatcagacagttgataatcagctccagcaaattccgctggaattgcggattgttggctatcaaacattgaacagccagacagcaatgctgccatacctaaggttgcaattaatttcacatttgatccttataaaagtgagaatgtgcaaaattctagcaatatcttcacaacagataaagcagcaaatgaatttagttttcctgatctgaaaaacttccgctataatgaccgcacttttttacgttaattaaaaggaattcttatgcaaaatccaaaagatgatgttttatatgcgcctgttgaatggatcgatcacagtgaaggctatagcgatattcgctatcataaatccactgatggtattgcaaaaattaccattaaccgccctgaagttcgtaatgcgttccgtccacaaacagtgaaagaaatgatgactgcattttctgatgcacgtttcgatgaaaacattggtgtcattgtattaactggcgaaggcgaaaaagcattctgttctggtggtgaccaaaaagtgcgtggcgattacggtggttacaaagatgacagtggcgtacatcacttaaatgtattagatttccaacgcgatattcgttcttgtccaaaaccagttgtagcaatggtggctggttatgcaattggtggtggccatgtattacatatgctttgcgacttaacgattgctgctgaaaatgccattttcgggcaaactgggccaaaagtcggttcattcgatggcggttggggcgcaagctatatggctcgtttagtggggcagaaaaaagcgcgtgaaatttggttcttatgccgtcaatataatgcacaagaagcattagacatgggcttagtcaatactgttgtgccttacgctgatcttgaaaaagaaaccgtgcgttggtgtcgtgaaatgttacgaaatagcccaatcgcgatccgttgtttgaaagcggcattaaatgcggattgtgatggccaagcaggtcttcaagaattagcgggtaacgcaacaatgttgttctacatgactgaagaaggtcaagaaggccgcaatgcgtttaacgaaaaacgcgccccagacttcagcaaattcagacgtaacccttaatttatcgttctaaagtgcggttaaaaatcttcgtgaattttgaccgcacttttgtattgggagcaagcatggctgaaaaatcatttaatctttaccgttattctatccccgttgatagccaacttattctgcgtgatcgttttttaaaacgccgtgaaggcttaatcgtaagagtgagttgcagccgagacggttggggagaaatcgctccgctacctggttttagcgaagaaaccttagaccaagctcaagaacaagcaatagaatggctaacgacatggtgcaatgcaagctgtgacgcacctcgcgtaccattagatggcacctatccctccgttgcttttggtatcagttgcgcaatggatgaaatgaaaggttatttacaagctgaaggcaattatcatacagcaccactttgttatggcgatccagatgaattgtacgccaaacttgcgagcatggaaggcgaaaaagtagcaaagatgaaagtgggcatatacgaagccaatcgcgatggattaattgccgatatgtttttagaagccattcccgatttacaattacggcttgatgcaaaccgccattggtcgttagaaaaagccttacaatttgccgctaaagtcaaactgcaacatagaaaacgtattcaatttttagaagaaccttgtaaaacacaagcactcagccgtgaatttgcagttcaaaccgacatcgcgattgcatgggatgaatccgtgcgagagcctaatttttgcttggaaaaagaaccgcacttatcggctgtcgtaatcaaacccactttaattggttcaattcaacgttgtactgagctcattaaccaagcacattcgttaggtctaaaagcggttattagttcaagtatcgaaagcagtttagggctctctcagcttgcacgaatcgcacaacaatacaccccgaatgtgactccaggcttagatactttagatttgatggaatatcaagtactacgcgcttggcctagttctgatttacctattgttgatttagaatctgaatttatcactaaaattatctgattcgaccaccaaaaatcgaaaaaaccagtataatgtgccacacaaaaaggattaaaaatgtcgcaaacacacagaattttgctgttaaatggcccgaacttaaatatgttaggggctcgcgagccaaaacattatggcagtatttctcttgaatccattgaagagaaaatacaaactttagccactcaacacaatgtaaaagtggaatgttttcaagccaatagtgaaggaaaattaattaataagatccacgaaagttttcaacaagtcgattttattttaattaatcctgcggcttacacccataccagtgtagcattgcgcgatgcacttttagctgtctcaattccttttgtagagattcatttatctaacgtgcataaacgtgaaccatttcgtcatcattcttattttagcgatgtggctgaaggcgttatttgcggtttgggcgcgaaaggttacgagtttgcctttttatttgctatggattaccttgctaaaaaataagaaaatcgagtatttttggcgaaattcacagaattttatcgcaaatttgaaaaaattaaggtaatctttgcaacacaaaagtaagtttattcataaccgcactttttcctttaaaagtgcggttaaaatttcaatctttttaggaagaacgtatggacattcgtaaaattaaaaaattaatcgaattagtagaagaatcgggcattactgaattagaagtgcaagaagaagagggtacagtacgtattagccgtgctgcaccagtaattgctccagcagccgttcaatatgctgcagcaccagtagtagcaccgactcctgccgctgcaccagctcaagttccagcagctgcgacaaccgcaccagccgcatcggatgagttatcaggccatcttgtacgttctccaatggtgggaacgttctatcgcagcccaagcccagaagcaaaagcattcgttgaagtggggcagtctgtgaaagttggcgatgcgctttgtatcgttgaagcaatgaaaatgatgaaccgcattgaagcggacaaagctggcgtagtaaaagcaattcttatcaacgacggtaacgccgttgaatttgacgaaccattaatcgttattgaataatttccaatatttttgtcgggcggactttagtccgtatttcatatacaaacaattagagcgaatttatcgtaggcgatataaattgaaatctgttcacgccaaattttatagggagaacaatatttcaagagcctacataaaaattcacgtctatctgactaaacggactcttttatgttagaaaaagttgtgattgctaaccgcggtgaaattgcactacgcattttacgtgcttgtaaagaattaggtattaaaactgtggcggttcactccactgctgatcgtgatttaaaacacgttttactcgctgatgaaaccatttgtatcggtccagcaccttccgcaaaaagttatttaaatattccagctatcattgctgccgccgaagtaacaggtgcggatgcaattcatcctggatacggtttcttatctgaaaacgctgactttgctgaacaagttgaacgttcaggtttcactttcatcggcccaacagcagatgttattcgtttaatgggcgataaagtttcagctattaaagcgatgaaaaaagcaggcgtgccttgtgtaccaggttcggatggccctgtaagtaatgatattgctaaaaataaagaaatcgccaaacgtattggttatccaatcatcatcaaagcatcaggcggcggcggtggccgaggaatgcgtgttgttcgtagcgaagacgcattagaagaatctattgcgatgaccaaagcagaagcgaaagccgcattcaacaatgatatggtttatatggaaaaatacttagaaaatccacgtcacgtggaaattcaagtattagcagatacccatggaaatgcggtttatttggctgaacgtgactgctcaatgcagcgtcgtcaccaaaaagttgtggaagaagcaccagctccaggtattgacagaagaagttcgccgcgatattggctctcgctgtgcaaatgcttgtgtagaaatcggctatcgcggagcggaacctttgaattcttatatgaaaatggcgaattctactttattgaaatgaatacccgtatccaagtagaacacccagtaacagaaatgattacaggtgtagatttagtgaaagagcaattgcgtattgcagcaggcttgccaatttcctttaaacaagaggacattaaagttaaaggccatgcaatggaatgccgtattaacgcagaagatcccaaaacattcttaccgtctccgggcaaagtaaatcacttacattcgcctggcggtttgggcgttcgttgggattctcatgtttatggtggctatactgtgcctccacattacgactccatgatcgcaaaacttatcacttacggcgatacacgtgaagtggcaatccgtcgtatgcaaaatgccttatctgaaacaattattgatggtatcaaaaccaatatcccacttcatgaattaattcttgaagatgaaaatttccaaaaaggcggaacaaacatccattatttggagaaaaaattaggtatgaatgaataattaaaattttaaacagctaacagatgttagctattctcttattgattttatagacttttattataaaaaaagatttcatagagaattaattgagacaactaacagctttttctatacaatccacccttctaattatttttggacaaattatgacaatcaacttaacaaaatttagtttaacgatacttgtagccttaacattaacggcttgtggaagcagtggtggaagtggtgattcacaatcagcacatacacctagtacatcaattcatacacaaaataattctactccaaacaagaatacatcaactcccccagtaaacgtttctaatgctaataatctggaaataaaaaataatgataaaactggtggtgcttttattatttcaggagaagatggacacgtaacattaaaaaaagtagatattactactaattctgatctaaatgttttgtatattgatgggactaaaatccctctttcctcaccttctattaaatcaaatggatggttaaatattagatcgggcacaggcaaagtttctattgatggaatagaaacctcacgggatctcaaagtttgttgtggaaaatacaccgatactcgtattggtaaagtgttaagtaaaaataaaaatgaagatacctacttcttttataatggtaacctaacgagaaatatgcccgttggtggtacagtaaattataatacaggcgatagcatcctatcatcttaccatgacgaattaggtgatactgatgaagccgttggcacttctcaattcagtgctgattttgtaaataaaaaattgacaggttctttatctgttaatgagaaaaaattaaatattaatgctgatatttcaggtaatacgttctcaggtactactcaatcagatgcttttaaatctcaaggtattgccgaaggtaaattttatggtgaaaacgcgaaagaattaggcggtttagtgaaagcaaatgataattcttggagtggtgcatttgcagccaaaaaataatctttattttatttaattaaagcaagcttaggcttgctttattctttcccaataaggataaaaatgagtatacaaactaaatttattttatttctcagctcatcattatttcttaccccatattcggttgctacagaaaaatctccacaaccacatgatgggcgtttagatgaacagctacatttggctaaaccaaatttgccacaaaaaacacccgcacttttgacgaataataatccgtcaaaattatctattacaaaagaagaattagccaaacacccagacttgattattcgcggtcttatccctgcagtattacaaaataatggtgaggcggtacaacttttattgcctctatatcaaccccttcctaaaaaagatccgttcttgttagaatgggcggaagcaattgacttacgagaaaaagggtatttttctgattccgttaaagcttatcgacacttattttcacaaaaaactgatcttttacctttacgctatcaattagcccaagccttgtttctaaataatgataacgaggcggcaaaagatcaatttcaaaaattaagagcagagcaagtttcctctgattctgtaaaaataattgaacaatatctttctgccttaaatcaacgagatcaatggaaaatccaaggtggatttagttttttaaatgaaagtaatattaataatgcgccaaaagccggcacaaaaattggcaactggacagcttgggaaaaagaaagtgccagaggattttcgtattttgggaatgctgaaaaaaaatggtcattacctcacaaccactttacaaaattgtccttggaaggcagtgggaaatattattgggataacaagaaatataatgaatttaacgcaagagctggtgtgggtcttggatatcaaactgcacgatttgaactctcattaatgccatttactgagaagcgttggtatgcgggcggctcatctggcggaaatgcaatgaaacaatactctaaaaattcaggtgctagattggatttatccaattggctaaatgaaaaatggcaaatttcgaccgcacttgagtatggtgaacaacgctatgaaactcgtaaacatctaaatggaaataactatctagcttccgctacgctactttacttggcgaaaagtggacagtattagtttggtggagctgattataatcgcgaaaatactcgagatttagataacgcttatcaacgaaaaaatgtccgattaggatggggacaagaatggaaagctggtatatcaactcgtttaattcttaattacgcacgacgtgcctataaagaaaaagatcttatcggtattcgtcaaaaaaataaggaatatgcatcagtccttactatctggcatagaaactttcatatttggggaattacaccgaaattatcttggtcgtatcaaaaggtaacaagtaatcatcctttttatgaatatgataaaaatcgaatttacgtagaaatcagcaaaaccttttgaattattcaaaaaagttgtaagattagcaaacacaagggacgtatgaaatatacgccccttataccattcaaaaaatatactttcacttataaaaaattttaaggaagaaatatgacattaaaacaacgttatcaacaagctggtaaagaagccagttgggcattgagcctatctattttatatgtgataggttggtgcttatgtgcttatttgcctaaagaaactcaaggccctatcggctttcccctctggtttgaactctcttgtatttatttgcctattctgtttattgtaattggtcattggattatcaaaattatttttcaggatatttctcttgaaattaacgatcaggggaatcaaaaatgaatttaggtattattcttcctttaattatttatctcacttttgtttttggtgcagcaatttttgcctatgtaaaacgtacaaaaggcgattttttaacagaatattatgtgggaaatcgatcgatgactggttttgtgctcgcaatgacaactgcatcaacttatgccagtgcaagtycttttgtcggagggcctggagctgcttataaatacggattaggttgggtattacttgcgatgattcaagtgccagtcgtatggcttgcattaggtgcattaggtaaaaaattcgcgctattatcaagagaaaccaatgctttaactattaatgatcttttcttttatcgctataaaaacaaatatttagtttggctatcaagccttgctcttcttctcgcattttttgcggctatgaccgtgcaatttattggtggtgcgcgtttattagaaacaaccatcggcatttcttatactcaagcattactcttatttgctttaacggtaggtatctatacttttatcgggggcttccgtgccgtcgtactgacggataccattcaaggtaccgtcatgatttttgggactataattctccttattggcacgatttatgccctcggtggtgtagaaagtgcggttaataaattaactgaaattgatcctgacttagtcacgccttacgggccaaatggaatgttagatttccaatttatggcttctttctggatacttgtctgtttcggggtggttggtcttccacataccgcagttcgatgtatggcatttaaagacagtaaagccttacatcgcggtatgctgattggaaccattgtactttcaattattatgttgggtatgcacttagctggtgcgcttggcagagcggttattccaaatttaacggtatcagatcaagtaattccaacattaatgataaaagtattgccgcctattgttgcggggattttcttagctgcaccgatgtctgcgattatgtccacaattgatgcacaacttattcaatcttcttctatttttgtcaaagatttatacctttctgcgaaaccagaagccgcaaaaaatgagaaaaaagtgagctatttttcatcaattattacgctgattttgaccgcacttttaatctttgccgcactcaatccaccagatatgattatttggttaaacctatttgcctttggcggactggaagccgcatttttatgggtaattgtactgggtatttattgggataaagcaaatgcttatggtgcgttaagctcaatgattatcggcttaggaagctatatcttgctcactcaacttggcataaaattatttaacttccatcaaatcgtaccgtcattagtatttggattaattgcatttttagtgggtaataaattgggcgaacgtcgtattgaaaaaactcaattaaaagttaccgcactttaagtattaatcaatatgctgtcaccttcttctaaatgagaggaaggtgatatttaattttctcactttcagcaatttctacgctaaaacatagaattgcaacaattcacagggatacatcaatgctctatcaaattcttgcgctacttatttggagcagttcattaatcgtcggtaagctcacttattcgatgatggatcctgtgcttgttgtgcaagtgcggttaattattgcaatgattattgtcatgccactctttttacgtcgttggaaaaaaattgataaaccaatgcgtaaacagctttggtggttggcattctttaactataccgccgtatttttattgcaattcatcggactaaaatatacatccgcctccagtgcagtcaccatgattgggctagaaccgctgctcgttgtatttgtcgggcatttcttctttaagacaaagcaaaatggtttcactggctattcggtgcaatggcatttattggcgtggcaattttaattaatggcggaaaaaataatgaaggcattgataacatcagtttattcggctgtttattagtactaagtgctgggatcattttcgctgccgtattacgttggacacagcgagttgttgccaaagtttcaaacgcaagcctatacctccgtcagcattgtacttggcaccatcacaacattgccatttacgctattactcacagaaaactggcaaatatcattaaattctacgggtattgcaggtttattatatcttgccattggctgtagctggcttgcctattggttatggaataaaggccttaatagtgtagatgccaatatctccggtgttttagtcgcacttgaaccgctattcggcattttatttgctgtatcattacttggcgaaacgctatcattttcagccgcacttggtataacaattattatgttagccacacttggctcgactttactgccgaaacttttaaaaaaatcggtataatatgcccccaaaattttggattatcatcattgtgaaaaaaattgatcaacaaagtttagaaaatgcctaccgtttatttgaaagcggtgatattcatcaaattgaaattggttcaacaaaagggctgcaacaaattcatcattacctatttaatggtctttatgaatttgctggtaaaattcgtgaacaaaatatttcaaaaggtcattttcgttttgctaatgcactttatttaaaagaagcattaggaaaaatagagcaaatgccagaagatacttttgaaaatattattaataaatatgtagaaatgaatattgcgcacccttttttagaaggtaatggtcgttcaactcgcatttggttagatttagttttaaagaaacatttaggtaaagttgtcaattggcaaaatgtggataaaacgcaatacttacaagcaatggagcgtagcccaattaacgatttagaaattcgttttttattacaagcgaatttaacagatgatgtaaataaccgagaaattatttttaaaggtattgagcaatcttattattacgaaggttacgagaaagaataaagtgcggtaaaaatacgcaaaattttgaaaggaaaaacaaatggcttggattcaaattcgcctgaacagcaccaatgaaaaagcagaacaaatgagcgattttttagaagaaatcggctccgtctctgtaacttttatggatagtcaagatacaccgatttttgagcctttgccaggcgaaacgcgtttatggggtaataccgatgttattgcgctatttgatgcagaaacagatatggcagaaattgtccgcttattaaaagaagcgaaacacttagatagcaatacggcatacaaanttggancaaatagangattaaagaactgrgagcgtgagtggatggataacttccacccaatgcaatttggtaagcgtttatggatttgtccaagttggcgtgatgtgcctgatgaaaatgccgtcaatgttatgcttgacccaggtttagcatttgggactggcacgcatcctacaaccgcactatgtttagaatggctagatggtcttgatttaaaagataaaagcgtcatcgattttggttgtggatctggtattttagccattgcagcattaaaacttggtgcgaaaagtgcggtgggaattgacatcgatccacaagccattctggctagtcgcaataatgctgagcaaaatggcgtgacagatcgcctacagctgttcttatctgatgaaaaaccctctgatttaaaagctgacgtcgtggtggcaaatattcttgctggccctctcaaagaactttacccaatcattagccaacttgttaagccgaatggcgatcttggtttatcaggcattttagaaactcaagctcaatcggtatgcgatacctatacgcaaacatttgcgttagagcccgtcgcggcgagagaagaatggtgccgaattacgggtaagctaaaaacgctttaatttctttttgtcaatcaaaaaaagtgtattttttaaacaaatttcactttgcaaagcaaggcaaaatgccgtattaatagccagccttgtcggttgtcgagcagttcgatataaattagatttaggcttgctaggaaaggaacgtaaaatgcgaatcggttcataccaattaagaaatcgtgttttacttgcaccaatggcaggtattaccgaccagcctttccgccgtctttgtgcatattatggtgcggggcttacattttcagaaatgatgtccacaaatccgcaagtttggcataccgaaaaatccaaattgcgtttggcacatagcgaagatttaggtctcaatgcggtgcaaattgcaggtagtgatccactcgagatggcgcaagccgctgctattaacgtggaatatggcgctcaaatcattgacattaatatgggatgccctgccaaaaaagtaaatcgcaaactcgcaggttctgcgttgttgcaatttccagatttggtggaaaaaatcttgcgagaagtagtgtccgccgtcaatgtgccagtgaccttaaaaattcgtacaggctgggataaatctaatcgaaactgcgttcaaatcggcaaaattgcagaacaatgtggcatacaagcattaacggtgcatggtcgtacacgcgcttgtctttttgaaggcgaagcggagtacgataacattaaagccgttaaacaagcaattgctataccagttatagctaatggcgatattgattctgctcggaaagcaaaattcgttctcaattatactggagcggatgccattatgatcggtcgtgctgccttaggtaacccttggttatttcaagctgtggaaaacctaattgagcataactcgataagtcaaatgccaagtttaaaagaaaagtgtggtcagattttgcgtcatattcaagaattgcatcaattctatggcgaacaaaaaggctatcgcattgcgcgtaaacacgtagcttggtatttacagggaattcaacctgattccgtttttaaacagacttttaatgcaattagtgatcctaaagagcagctgattgtattggaagattttttcaatttaattttggataaaaaaaatgttagaacaacaacgtaattctgccgatgccttaacggtatcagtattaaatgcgcaatcacaagtgaccagcaaaccattacgcgattcagtcaaacaagcgttgcgtaattatttagcacaattagatggtcaagatgtgaatgatctttacgagctagtattagcggaagttgaacaccctatgttagatatgattatgcaatatactcgtggtaatcaaactcgtgcagcaaatatgcttggtatcaaccgtggtacattacgtaaaaaattaaaaaaatacggtatgggataaggcgatattcttttattaacaaaaagattgaatgtttttcattctattttaaaaattagccccaagtaatttggggctaatttattattacaatttaagatcttcgatgtgcatttttcataatgcgatcttttgttactttccattcacgttctttaatatcatcacgtttatcctgttgttttttacctttggctaaaccgattttgacttttgcccacgcacttttccaataaagagaaagtgcaactatggtaaaaccgtctcggtttgctttaccaaatagggatgctaattcgcgtttatttaacaataacttacgagtgcgagttggatcacaaacaatatgcgttgatgcaacatttaatggctgaatgcttgcgccgaataaaaaggcttcgccatttttaaaaataacataactatcactaatatttgccttgcctgcgcgcatagatttgacttcccagccttgtaattcaagacctgcttcaatttcatcttcaataaaataatcgtgtcttgcacgtttatttagtgcgatagtatttgaattgggttttacttttttctttgtcataattttatcccttattttgcctgaggcattttatcggatctctattttgatagcaaaaagatcatctaggtagaactggcagtcgcatttattttcaatctttaaaaataaatgatttgtagaaaataagagaaaaactgaccgcactttttaagaaaaaacagacacattgttgtgtctgtttgggaaagataaaaagatgaattaagtgttagcgatttatatagtgaataaaggattattccaaacgttttgccactttaagccaatcagccttaaatacacgctgcatattattaatggcatcaataatatcgtgatgaacgagttgttcattttggatacctacgcaatagccgcctttgccttgtagcaataaatctactgcgtatgcgcccatacgtgaggcaagaatacggtcaaaagcacaaggagaaccaccacgttgaatatgccctaaaacagttgcacgagtttcgtgtccaacgcgagcttcaatttcttttgccagagaatgaacatcggttaaaagttcagtgatagcaataatagcgtggcgtttaccgcgaataatgctacgttcaatttgttgaattaattcttcacgattaaattcaatttctgatgcgacgatatattcacaaccgccagcaatgcccgcagaaatggttaagtcactacaatggcgacccataatttcaacgatagaaatacgttggtgtgagcttgatgtatcacgtaaacggtcgattgcatccactgcagtttgtaatgcggtttgataaccgatggtatagtcagtacctgcaacatcattatcaatagtaccgggtaagccaacacaagggaaactgtgttcttcggttaataattttgcccccatgtaagaaccgtcaccaccgataaccacaagtgcatcaatgccgtgagaacgtaaaatttccgcacattttgcccgaatattaggatctttaaattcaggaaaacgtgcagaacctaaaaaagtaccgccacgattaatcacatcagatacgctatagcgatttaattgtttgattttattattgtataaaccttgataaccgtcatagataccaaatacttctaagccttctgcaagtgcagaacgtactacgccacgaattgcggcattcataccaggcgcatcgccaccacttgttaaaactgcaatttttttaatcataatttacctacttttaaccataattgaaaatgggcataagattacatcattcaaagaatctgctctagcaaaatttgacgggattttgatctacattatttttcacaaaacagttgccatttcaaattttgtaaatgctttctttctatatccacaatgtatttttgcaaatgtcgttgtactttattgacagataaatgtttagaacgcgttggttgctgtattttctgcgaatattgaaattgcacaaagccacattgggacaattgtcgtcctttcatcacattgacttgccaagatggattttctttcgttggcgaatagataacatatccatttaattcatttggattggtcgaattttctggaatagcatcgaaatggaaatcttttacgcctgtattgcgataaatgcgttctcttaatgcaatacgttctttaatagaacgttcgggttgattgcgatcaaagagaatttcaatttcagattgccaattttccagcgtatctggtttagcaatatacacatagcgtgcaatggtttcgaaatcttggctgccagtaagtacataatgttttccattatattctaactgcgtaggcacatttaattgcgtcagcttagttgcacagcctgaaagtataagtgcggtcaaaataacaaaaattttattcattaatatctcgcttaaagacaaattcagtttcagtggaggatgctgaatcaaaccaataaccacctaaatcaaattcttttaactgttcaatttcagttaaatgatgttgaataatatagcgacacattaagcctcgcgcttttttcgcataaaaactaattactttgtatttgccatttttattatctaagaaaactggcttaataattttagcgttaatttggctttctttaacagatttataatattcgtcagaggctagattgactaacacattatcgccttgttcatctatagcttgttgaaccgcttgggtgatcacatttccccaaaaggcatacagatcttttcctttcggattggctaattttgtgcccatttctaatcggtaaggttgcattaaatcaagtggttttaaaagcccataaagaccagaaagcatacgtaaatgggattgcgcaaaaatgacatcatcttccgaaagggaatcagcatctaaaccagtataaacatcgcctttaaatgcaaagagtgcagggcgggaattgttttcattgtgaatttttgtccattctgcaaagcgtgcagcatttaaaccagccaacttatcgctgatagacattaatgatgaaagatcttgtggagaaagtttacgacaaacctcaataagttgttcgctgtaatcggtaaagtgcggttgagaaacaggaaaattttttaccgcactttcaaaatcaagggttttggcaggggagataatcgctaacataatcgtccttttatgaaaaaaagaatgggcgtatcttagcataaaaatttacgctaaacgcgtttatataacccattttcacttatgataagatcttgcaactcaagatcgagcaactgaacaagcaaaacatcgacgcttaaattaaattcttccgctaaatcatcaatgctcactggcgtgtaaccaatacgcgaataaagtttcgggtggcttggtgcttctactaatcgacgaggatcaggtggtggcgtgtaattaggcacggcgatctggtcaaaatcaatttcagtttggctatggattgaatgttggtagagagtttccaaaatgtcctttgcattttctaccaacattgcaccttgtttaattaggcgatgacaaccttgacttgatttattttgaatgtttcccggcacagcaaaaacctctcggttttgttccaacgcatatcgcgcagtaataagcgagccgcttttttctgtggcttcaacaacaagcgtgccgactgaaagcccgctaataatccgattacgacgtgggaaattagcggcaatgggggcttggtttggtaagaactcagagactaatgcgccattattttcgatgatttgtgccgataatctttgatgtttagagggatagatttgttctaatccactgcctaaaaccgcaatagtttgtccttgaatattgaccacagcttgatggcaatgtccatcaattcctaatgcaagtccactagtaatcgtaaagccagctaatgaaagttctgtcgcaaaatgttttgcccaatattctccgtaagtcgtgcaataacggcttccaaccattgccatttggcgttgtgaaagtgcggttaaatttccttttacaaataatagtggcggaaaacttgcggtctgtttcaacaaaaagggataaaaaggggaaaaataattcactaaatgatttccctctttttgtgaccacacaagtgcaggctcaataaattttgcttcaggcttgaaccaacggcgaatttggatggctccccaccccatttgtcggaaagcaacatcatcataattaagtaattcatttaaggtaatattggacaaaattttatcaatgccaacgccgccaagtttaggcacttgcattaaacggagtaatgtgtaggtaatgtcattcatattttttcctttttatttgaaaatctagtatggaaaaaacgagggagagaaacgattaatttaaaagcattttgcgatgcagatcgcaaaaattctttttaatgaataaaaaattgcaaaatttttcttattttgaaaatgtaaaaaatccaataagaaaaatttgttgattagggttgtattggttaaatatgctaattttattaagtttattagttaaatgtatatttgatgaagtgtaagtaggtttatttttaatataaaatgccaaaaaatagtttgacagccagttttttattcgtaatatggaaaacgttttacacagaggatttttatttatgtttcgtattgtttctttatctctcaacctactgctctcacattttgtgtgcggctaagttgtggataaaaaaacagtcagatgtaaatacccaattttaaacccgcactttataagttgcgggttttttatctaaaaaatacaggaaaaacgcaccgcacttttggagtgattttagaggaacttttagtaaggacatttagtaaggacattgttatgacagatcgcgttattatttttgataccaccttgcgtgatggggagcaggcattaaaagcaagtttgacggtaaaagaaaaattacagatcgctttagcacttgaacgcttaggtgtggatgtaatggaagtagggtttcctgtttcttctcaaggggattttgaatctgttcaaaccattgctcgccatattaaaaacgcgcgtgttgctgcgttatctcgagcggtagataaagacattgatgccgcatacgaagcattgaaagtggcagaagcattccgtattcatacgtttattgcaagttccgcattgcacgttgaagcgaaattaaaacgttcttttgatgatgtggtaggaatggcagttgcagcagtgaaacgcgcacgtaattatacggatgatgttgagttctcttgcgaagatgcaggccgtacaggcattgataatatctgtcgtattgttgaagcggcaattaacgcaggtgcaactacggtaaacattccagatacagtcggtttttgcttaccaaatgaatacggcaatatcattgctcaagtgcgtaattgcgtgccgaatattgataaagcagtgatttccgtgcattgccacaatgacttaggtatggcaaccgctaattctttaacagcagtacaaaatggtgcgcgccaaattgaatgtaccattaatggaattggcgaacgtgcgggcaatacctctcttgaagaagtggttatggcaatgaaagtgcgtcaggattttatgggtgtggatacccatattaatactcaagaaattcaccgtgtcagccaaatggtaagccaactttgcaatatgccgattcagccgaataaagccattgtgggctcaaatgcttttgcccattcttctggcatccatcaagatggtatgttgaaaaacaaaaatacttacgaaattctgtctccagaaaccatcggtttgaaaaaagaaaaattgaatttaaccgcacgttctggtcgtgcagctgtgaaaggtcatatggcagatatgggctataacgaacaagattacgatttggataaattgtatgacgagttcttaaaattggcggataaaaaaggtcaagtttttgattatgatttggaagcattggcgtttatcgatatgcaacaaggggatgaggatcgtttggtattagataaactttcggcacactccaccaaagaatatccagcaactgcgtttgttcaattgaagttggatggcgaaaaattaagtacgtcttcaattggcggtaatggtccagtggatgcggtttataacgccatcttaaatttaacgggtttagaaatcaaaatgtctcactataacttaactgctaaaggcgagggcgcagaagcattagggcaagtggatattgtggtagaacacaaagggcgtaaattccacggcgtcggtttagcgacagacattgttgaatcttccgcacttgctttagtccacgccatcaatgccatttatcgagcgcataaagtggcagatattaagaatcataaacatcattaatttatcgagttcccctttttagcaaagaggggaaaaatacaaaaaaactaaccgcacttttgaagtaaaaaataggaaaaataatatgcaatcatacaatatagcagtattagcaggcgatggtattggtcccgaagtcatggcggaagccattaaggtattaaacagagttcaagaaaaatttggttttaaacttaactttaacgagttttttgtcggcggcgcggctattgagcattgcggttatccgttaccagcagaaaccttaaaaggctgtgatcaagcggatgccattttatttggttctgtaggtggccctaaatggacaaatttaccaccagatcaacagccagaacgtggtgcattattgcctttgcgtaaacatttcaaattattctgtaatcttcgtcctgcaaccctttataaaggcttggaaaaattctgtccattacgtgcagatattgccgcaaaaggttttgatatggtggtggtgcgtgaattaacgggtgggatttatttcggtcagcctaaaggtcgtgagggggatggcgtacaaaccaaagcatttgatacggaagtgtattacaaatatgaaatcgaacgaattgcacgtgcggcttttgaggcagcaatgaaacgcaataaaaaagtcacttctgtagataaagcgaacgtattacagtcttctattttatggcgtgaaactgtgacagaaatggcaaaagactatcctgaagtgactttagagcatatctatatcgacaatgccaccatgcagttaattaaatcacctgaatcttttgatgttttactttgctctaacattttcggcgatattatttctgacgaagcggcgatgatcacaggttctatgggaatgttgccatctgccagcttaaatgaagagggttttggtttatacgagcctgcaggcggttctgcccctgatattgcaggcaaaggcattgctaacccaatcgcacaaattctttctgcggcaatgatgttgcgttatagcttcaacttaaacgaagcagcagatgccattgaaagtgcggttcaaaaagtcttggcaagtggtcatcgcaccgccgatttggccgatgattccacaccagtttcaacggcagaaatggggacattgattacacaagcaatttaatacttgccttcctccgtttacgggggaaggtgcctgaagggcggaagggggcaatctccacccttagttatttagaaatatccccaataaacaggggggacaaagtatttaaagtgcggttgaaaaacacatcgaattttaaccgcacttcccttaacgaatagagaaaaatattatggcaaaaacactttacgaaaaattatttgattcacacattgtgtatgaagcagagggcgaaacgccaattttgtatattaatcgtcatttgattcacgaagtaaccagcccgcaggcctttgatgggttacgcgtcgcaaatcgccaagtgcgccaagtgaataaaacttttggcacaatggatcacagcatttctactcaagtacgagatgtcaataaacttgaaggtcaagcgaaaattcaagtgttagaattggataaaaataccaaagcaacaggtattaaattatttgatataacaactaaagagcaaggtattgtacacgttatggggccagaacaaggtttaaccttacccggtatgacaattgtttgtggcgattcacacaccgcaacgcacggtgcatttggtgccttggcttttggtatcggtacttctgaagtagagcacgtattagccactcaaactttaaaacaggctcgcgcaaaaagtatgaaaattgaagtgcgtggtaaagtcgcatcaggtattacggcaaaagatattattcttgctattatcggcaaaactacgatggcaggcggtacaggacacgttgtagaattctgtggcgaagcgtccaagacctttctatggaggggcgtatgaccgtctgtaatatggcaattgaaatgggtgcaaaagcaggcttgattgcgccagatgaaaccacatttgcatatttgaaagatcgtccacacgcgccgaaaggcaaagattgggaggatgccgttgcttattggaaaaccttaaaatctgacgatgatgcacaatttgacactgtggtaacgctagaagcaaaagacatcgcaccacaagtcacttgggggacaaaccccgggcaggtaatttctgtgaatgaaaccataccaaatccgcaagaaatggcagaccctgtacaacgtgcttcggcggaaaaagccttacattatattggcttggaagctggcactaatttaaaagatattaaagttgatcaagtgttcatcggatcttgcaccaactcgcgcattgaagatttacgcgcagcggcggctgtgatgaaaggccgtaaaaaagctgataacgtaaaacgtattttagtagtaccaggttctggcttagtgaaagaacaagcggaaaaagagggcttggataaaatctttattgccgcaggtgcagaatggcgtaatccaggttgttcaatgtgtttaggaatgaacgacgaccgtttaggcgaatgggaacgctgtgcttccacttcaaaccgtaactttgaaggtcgccaaggccgtaatggacgcacccatttggtaagtcctgcaatggcggcagcggcaggagtgttcggtaaatttgttgatattcgtgacgtaacattaaactaaggctcaaaagaggaaaaagaaaaatggcaggatttaaacaactttcaggcttagtcgtaccattggatgcggcaaatgtagataccgatgcaattattccaaaacaatttttacaagccattacccgcataggtttcggcaaacacttattccacgaatggcgttatttggacgtagaaggcaccaagccaaatccagaatttgtcttaaattatccgcaatatcaaggtgcaacaattttgttggcgcgtaaaaaccttggctgtggttcttctcgtgaacacgccccttgggcattagcagactacggctttaaagtaatgatcgccccaagttttgcagatattttctataacaatagcttaaataatcatatgttaccgattcgtttaagcgaagaagaagtagaagaaatcttccaatgggtatgggcaaatgaaggcaaacaaatccacgtagatttagaagcgatgacggtcactgtaggggataaagtttatacttttgagcttgatgaattccgccgccattgtttgctaaacggtttagataatatcggcttaactcttcagcacgaagacaaaatctcagcatacgagaaaaatattccagcgtttttacgttaaaaataaaaaatgcgctgatttttcaccgcacttaatcactgaatttcattcaaaaataaagccctgtaagacacagggctttgttgtttataacgttaattcaaacaggcttattaaaaactaaaacttagttttaattctgcagttttttgtttttccgcttgtttcgcttttgttaatccgcctattagacttaatttcacattatgatatttcaatttaagccctgcgttatattgctgttggttttccacgttgtaagcaaaatcatattgatttacattaatttttccgctgccttgatttgtatcatatcgagcagacaaaattggcgtaacggaaaactcgcctaagtgataagtataacttaaatcaacttgagcaaaggctgttttgacagatattggatttactttaatgcgatctttagctaatgcaaaattagcgtttgataaatagctataacgcacgcctactattggcgtaataccaaaattgccaagattaaatgctttgcctgcggttaaaccaaattgtgcagtatggcgagcaaatttcgcattatgattggtttttaggttgctttggaacttgccgtagcctaaatcaatgcccaaataccaatgattatccgcataatatttagaatagaaattaacttgtgctagagtatttttactgcttgccttatcaaagttgttactattgcgaacataagtaaacacgccacctaactgaacattgtttgagattgtttgatcccaaccaagttgagtttgcgtacttttagaactaaaacgacgatattgacttgaggaataattttcgttcattgaagtattagatacccaaacgttatattgcccctcgttattcatttctaactggctaatatgttgagaaactgctttccccacatttaatgcaacaaattgtgcttttgccattgcatcagaaattaccgcatttgtgtttgtacttgtgagatcgcgcaatgctactgtagaacgatcgctgccatttgtaacagttggttccgagcgaacacttcttctacttctacgatttggcttactgcgttttgaattatcagctattgttgtttcgtcagtagaagctgctgttgtttcttcagcagaagtctcttgaggctggctaatacttcttctacgtctactctttggatcactgctttctgaattatttgctacagaattatccgcaacagtattcgctttatgctgactagcatcttcagtcgaagccgcagtttccgtttgtggtttatcggatttttcagcagtttctgttattgcggttgcagatccagtatttattgaattctctggtgcaggttgtttagtgcttactgttgcacttgtttgtgtttgcagttgagcttgaacttcttctgcattattaacagtcggaacattttcactttcaagcactgcttgcggttgaacagtttcagactgttcctgtttcggagacgcttgagaagccacttgagggggttcttgagttttctctgtttctactttagccgttttctctctttctgttggttggtcggtcgtattttctgtttgattttttgatactacaggcgttacaggttcagcgttagttttttcacttggttgagtttcttccgctggtttactgtttggcgaagttgcctctgccgcagcaacagttgtcgattgtgtttgcggttgagcttgaacttgagtttcttctactttcgtatcagttgaaacttctttaggagcaggctttgcttgtttcggagacgtttcagaagccatttgaggtgcttcttgaatttcatctttttctactttagccttttcctctttttctactttagctgtttcttttatttcagtcgtttgagtttcctcggtttcacttccactttgagccacttcatttgtttgagtattagcttttacacttggtttagcttcttctgcaacttctccattttgagctgttgtctcggttgcgtcttgctcgtttttctctactgttttactttcttgcttactattttcagccactgtttcagttgtctctgatggtgtagcaggcgcaggtggtggaactggtgtttcaacacgggctatttcttcattgttacttggtacgctaggcacatcagcttgaatattattaggtgttgtgatatttgtcgtatcgacagtttgatttcttttttccacctctgggttatacaaatcgtaacgtccattaacattacgtaatttatatttccaagcacctaaatcaacggtattcccaactaatgacacattcaaattatttcttgtagcatttgacgcatcaaaaagcgtgagttcattttttgtaggctcgcctgttttatctgccacttgtaatgtaaagttacctgtggcggatttagttacaacaactttgtcgccttgtttattggaaagatcagttaaataatagaaagaaccgttacctgataagctattcacagtcagcgtgttatatgtagttactttatttgcatcgttttgtgcatttaaatgaatatgccccttgtctaaatttaactgattaacattgctatcgcctgttaaatgccaatggctattttcggttaaacgtacttggctatttcccgtgccgctaattgtgccgaataagttagctttgcctaagacaaagtttgcattacctgataaatttacattgccagatacattggtggcgttaaagctattaagggctttatcggataacttgtcagtagtgcaagtcacatagcccgtatagtcagaacgtacacaaacggtatcgcctgctttatagccaatatgtacttttgcattatcagaagctgtgatatttgaagtaatgtttgcaacattgcgacctgaataaagggttgcgttattggttacattaatatttgttgctttaaaattgcggttaatccagtcatcttctactaccacttcattattttcagcaaagtgttgatctttttttgtcgaagaaatacctgcaatatctcttgcgtgcggtgttggtctgccagaaaggaataatgtgcctttttcaacctttaaatcgccattaaggtttgttccgcctgttaataaaaagcgattttgctcacttttgcctttaaaagtcacatttagattaccgttatttttaccctcttcctcgccaaaataaccgttaaagccattcatacgctcgttgttgatatggttcattacatttcttttggcttcatcggaagttttacccatatatagccaattttcattgctttcgccactatttttaggtaattctgaacgagtgctcgcaccttttcttaacgcataataagtgtaattttccaaatttaaatagagctgtcctccatctttaatccgtcgaaaggcataaggattatcttcatctggtgcgtctatattatatggagtaattgtatttggatctgtaattagactttccccagtaattgttacagtagaggttttgctggtattgtgatttactagtcttgcgccatcatcaatattacggatatgttcaaaagtgagattattgccattggcatctaatcgaccacctctaaagccaaagtaaatggaatttggatctacttgcttatcatcattaagtacaacagttgagcgaccacttactatacctacttgtgaaaaggctttaactttattattggcatcagcttgttgttttaagataacagtaccatcgcccacttttagcgaacctttattttctccctttccttctacaattaatgttcctttgccgattttagctaaacgatcagatttcgggttatgtactttccacgttactgtttttccatcagcaacagaaacgccagctcctttccaagtggtactatcagaagtgcctttaacttcataatctccttcaaagaacaagccgcctgcgccttgatcgatattattatttaaggtaagcgttccacttcctctaagagtcacactttttccgtgattgttcttcttagagtcagtatcctgactactatcgaataaatcaacatttagagattcagaaccattagaaataacgcttgttttgccagtaggattccaattgtattgggtgttagaaccagttaaagaacctgcagtatctttatctagaacagtttttgcaaattcaggtttataaatattccattcttgccaagattttttgttataacctgcccaaaaatcataagacccaagraaaagccattttcctttttctctatcatatacaaataatggggagccactgtcgcctaaaacagcataattggtaagcggatcttgagataatattccttttggatcgctgtgttcctcttttgaattgccaaaaccaattagtccattattttcgtggtttactttataaggtgtgcctgcaataccataggtataggcatcgcccaccaatttaagattattgcctccaacctcatgattatttaaaattaagctgtaattatctccttttttataaataaattgactaccacttcctagtcttacaaaagcaggatatttattctgatcattatatgtgccagcatcactacttgcagttgaagcctctattggtgcaacttcggtaacaaatttatcaagacgtggcatatagtagtcttcacggcgtttttgagtttgatcttcagtagttactgcttttccattcaatttagttggatactcatttttctcaacggaaaaatatctattttcttctgaagatacatctcggtgcgatttagcattgccattattcatattgccatttaagttcccaaaatgtagttcactcacgccgttactaacgtgttttacacctactacatattgtggatttatcaatgtggcgatgcgtttatctacatccacaacactaaaatcaatcatcggaatgccattaggtaaaacattgcctaaagagtggttatttttatctctcacttccacatttgttgcaccaacagaaaatctccctttattttctgcaaaatcacgaaatatttgataatccacatcgtctctcactaacgcagcttctgtataaggggttaatgcgtaggcgacagtaagcgcaataaaattgagtttgaattttttatttagcatagaagctgtccttattaattaagtttaaaaagtagatttgataggacacaatttgatatacggttacaagttgattcaaattttggctgtgttgcgttgataatttgcaagttgtcttcatctttataatgagcgagctttatagcataaatcgctcaaaacttgaattacatttatgaggtaatgataataatttttgatattttttaaaaaattggcgtattttccaccgcacttttggctaatttaaggcgttaatgatgccattatgaacagaaaacatttttttattttccacttgcatttcttttagttgtctttgcgtaatggcggtaacaaacacttgtgaaccgctttgttgtaatcgttctgccaacaaggcacgtttgtattgatctaattccgaggcaaaatcatcgatcaaaaaaatacaatggcgttgcttttctttcattaaatgctcgccctgcgctagtcttaatgcacacattaaaagtttaagttgtccacgagaaagcacatcttccactggcaatccttgtgctttgaaacgaaaatccgctttttgagggcctgaaaaggtgtaatttaaggcacgatctcgttcaaaattttgttgaagaatttcataataatcagcatttttttcccatccttgatgaaagctgacattaatttctaattcaggcagaaaaagttggcaagtttgctcaatttcagggctaagtgcttctgcgtattcggcacgccattcacttacttggtgggcaagtttagcaagttcaacgtcccaaatttttatggcagagtaaggctgattttgtgcaagggcggcatttcgttgtttgagtaatcgattgagattgctccaagcggaatagaaacttgtttggtgatggaataatccccaatctaaaaacgcgcggcgataacttggcccgccgttgagtaaagttaagccctctggcgtgattaattgcattggtaaaagatgggcgagatcggaaattttattgccatcttcgccgttaatttttactaaggtgttgccttgacgcagtttttgtaagccgatagaccattgatgttggctttcttggatttgtccaaatagggtaaagtgcggttcgtcgtaagaaatgatgcgatttgtgaccgcacttttaaatgaacgtccgtgaccaagataaaaaatggcttctaataagctggtttttccgctgccgttgttgccgattaaaaagttaaagcagggatcaaaatcaagatccactgctgttaaattacgaaatttttcgaccagtaaacgagaaatcgccatattataaacgcattggcataatgacgtattcgcagctgctgtcttcacagttttcaattaagcaactggagaacgcatcagttaagcacattcgcacttgattacatttaagtgcattcagcacatcaagaatataggtcacattaaagcccacttctaattcttcgccattgtaattgacatcgacaatttcttctgcttcttcgtgttctgtatttgaggcagtaattttaagctggttttcctttaaacttaaacgtacgctgcgtgcgcgttcattagataaaatagacgcacgagcaaaagcctgtttcagcatttcccaattgccttcgacaatttttgtggcattacgaggcaatactcggcgatagtcaggaaagcgaccatcaattaattttgatgtaaatactgtgttttttaaatggacacgtaaattgttggtgccaatttgtaagcgtgctggttcatcgtttgtttctaataaacgaacaagttctaacacgcctttacgaggtaaaatcacagaatgattttgtaattcttgttcaagtgagatagtacagaccgcaagtctatgaccatctgttgccacagttcgcaataaattgccttctgtttcaaacttcataccatttaagaaatagcgggcatcttggtttgccatagaaaattgagtggcttcaattaaacggcgtaaggtattttgcggtagttcaaaatccacttcagactgccaatctgtgaggttgggatattcttcggcaggttgggttgctagtgtaaaacggctacgcccagattgcactaatgcacgatcttgttcaaaagtcaccgtgatttctgaatcatcagataaagtgcggcaaatatctaagaatttttttgctggaatggtaaaagtgccattttcagaagatgatgaaagttgagtttgactagagagttcaacttctaaatctgtccctgtgatagtcagacgatagtcttcaatttgcaataatacgttgtttaatacaggaatatttgggcgattactcaatacgccacatacttgttgcaacggttttaataaattttctcttgaaatactaaattgcattacgttctccttttatgcggacaaagtgcggatcaaattcgcccaatcttcttgaatgctattgtcttgctcacggaattttggtacttctcggcaagcgtttaatacggtcgtgtgatcacggtcaaaggcacgaccgatttctggcaaactgcgatttgttaattcttttgctaacgccattgcaatttggcgaggacgagtcactgaacgtgcacgactttttgattttaaatctgaaaccttaattcgataatattcagccaccactttttgaatattttcaatggtaactaagcgttcttgcagagccaaaatatcttttaaggtatcacgcacgaaatcaatatcaatgtcaccgcctttgaagtcttgcattgcttttacacgatttaatgcaccctcaagttcacgcacgttggtacgcaagcgttgagcaatgaagaaagcgacttcttctggcaagttcatattatgttcttccgcttttttcaataaaatcgctacacgggtttcaagatcgggcggttcaatggctgttgttaagccccagccaaaacgtgattttaaacgttcttcaattttttcaatttctttaggataacgatccgaagttaagataatctggcgacctgtttcaaacaagctattgaaaatatggaagaattcttcttgagttttttctttttcagcgaaaaattgaatatcatccactaaaagcgcatcaagagaacgatagaattttttgaactgatccattttattatcacgcactgcttttaccatatgttgcataaagttatttgcgtgaatataaagcactcgtgcattcggtttatcggctaaaatgccgttgccaatggcgtgtaacaagtgagttttccctaaaccagtgccgccatataaaaagaaaggattggctgatggttcgcctggtgcttgagcaagtttttgaccgactgcacgtgcgagttggttcgatttaccttcaacaaagttatcaaataagtgtttagtattgagatgagattcaaattttactgaagcactagattcagcttgaaaatctaccgcactttctgatctaagtgatgtatttggtgtgctttccactatcttgggtgcaggtttaaccccttcttttaaagaaatacgcagttcaggattttgtgcaagtgtttgacaaatttgctggatttgtgcgagataatgagtttccacccaacctttcacaaacatattagaagcatataaaacaatgtggttatccgccaccacgtcagcctgtaaaggacgaagccaagtgctaagatcgctggctgaaacttgatcttgaagttgtaacaggcaactttgccaaagatttgagagattcacaaaaggatccttattgtttttgtaatagagaaaagtgcggtaaaaattgtcggagattttacaataaatgcgtgaaaagatcttctaaaaaatccaagtttgacctttcacttaagcagattatagaacagaaaaaaatgcgccagtattgtatagatatagcatatttaatctatctggcgcattttaatttagaatttcatttctaatgttaaggtatagtttcgtcctgatgctgcgtagcgagtatagttaccaacattttgatgttgattgaccgcaccttgtgctgtttgacgcaccgcttcccaagtaacataacgatagttgaataaattatatatccctaatcgaagcataatatttttattcgccatgtaataacccgatacatctaagatatgccatgcccgagtaagttttcttgttgattttacatcccttgaattgttacctaatgcacgttttcctagcaattcattttgagattttgcttttgattgggtaaaggtagcatttactccccaagtattacttatatgatcatagcctaaaccaatgatataacggctgggctgaatggcatcaaataaataactgcttacggaggctaaaccagcattgattttttgatctttaacttttactcggttataagcaaatgttgcataccaaccgtagggaatacgtttccataaaccattaaaatctaattgcgcagttatatttacaccaactaattttgcattttgtgcattatgatatccataattgccctttccagttccatttttactaagttcttcagcaaaggcgataagatttcgataagcattactaaaatgactgatctcaatattaccaaaatccccttttagagcgagaccaaactcttggttacgagatgtttcaggcttaaatttacctacataaacctcgtcattcttgccaccataccgccaaccatacatttcagcaaaactaggatttctaaatccagtagaaaggcgataagaaagatcaagccattccgttggttttatgacaataccagtattccaagagaaatttttaaatttaccaacactaatagttgattcattagcttttgtacgagatacgtcataccgaatacctaaacctaaatcaacgtatttccctaatgccatattattgcgtgctgcgaaataataatttttccctttaattaaccgcactttacagtctctgtaattagaggaactaccttgataattacaatgatcttctcctgcaaaatatggctttggttttgggtataagtaagggtattcgcgtaaaccatttcttcttgttttaccagttttatctgaaatactatctgccgtagcgataacacgtcgagttaaataatctttatgctgaagtgcggaagtaaagtcatcaaaaccaagattgaagacaatttgatgagtaagccaattttgttgaatttttttctctaaattcaattgcaacatattatgtttttctttataaacatttctatcagaacgatagtatgaataaggtttatcaagtgttgggcggcaattcttacttggattaggataaagactgcaatgcgtatgtcgcatataactgtcaagtatgatgttttgttgattagcacttaacactgctttgtcaatgatgcccgctttgttcttattttcgtaaatatattcaatacctacacgctgttttctatggtgttcatcgaaataaagcccacttgcatatttaacgcctcggccatcctcaatatgttgatatgcgccataatcttgctttggataaaaagggcgatttgctaaatcccctttttctgttgggcttaaataagcgggaaatgtcatatcacggatatcaaatttttgttgtgtgaattcaaaaataccaccaatataatgttgttcagaaaaatgataccctcctcttaaaaaccaagactggctttcatatttcattggattaggtttgatacggttagcccccgtataatctgaaacgcttacggtttcttttttggtggataaaatcgcaggtggtttggctgaaggtatacactcgtcataaccctttggacactcatcttccatcacaaagtatgcagattgattctctggtttggcgattaagcgattataactttgcacgccttttaatgcatctttatggacttgggtttcaattgaatttcgttgagtgtaaatagcaagtccttcaaatccaccttgttttcctgctacagctaaagaatgggtaaagcctttatttttgcttgaataagcatttttagtttgaattccccatgatttgtctccttctaagatatcggctgcggatttgctttgaaatgttacagaaccagctaatgctccatttccatactcagaagaactcccccccttgcttatttcgacggcctttacattttcatattcaatttcattaattgcaccagtgccagaatatcctgaacgagcaactaaagggctttgcactacataagattgcgtttgaggtaaaccatctaccaataaagcaactctatttctgtccataccacgaatagaatatccagaacttgcaccgcgaccttgttctacaactgaaatccctggatcatagcgtgttagatcacgaatatttaatacttgttctcggctgatactttcactagttttgataattttgccaagtccagttacttcattatctttacgatctcttactttttctgcagtgactgagatagtttctaattctgaatcttctgtactttgagtgtccacttcagatgatatagcttcttttgtatcttttatactttgagtttctgcttttacatagcatgaaattaaaagacaagaaataatacttaggcgaaaatagggttttttagtcatttttagtattccattatttggttgtttctacttgttgtttgtttctacttgttttttagctccaaacacaactgcagctcttgccttttctgaattggatggtgaagatgcggttggggaatttttatctgtaggattttttccgttataggtgaaataccctcctaattcagaagcattaggtccataaaatgccccatttactttagttgtaatattaattggggtatttttagtttgactatttttaccatctattactaaatcttttgcggttgctgtaccagtgaaggcattcccaccatttttaaagtttgcctcaatactaaatacgggattttgtgagtctgcacgttttaagctcccttttaatgttttctcggcaaaatttacatcaaactcggcgacagcatttttatcttgtcgtttatctcctgtagtggagtaagatgtctcgccatcactaatataaccaaaccaactaccgcgatatttcacgtttcccgttgtaggaattttagaactggcagtacggagacctaacaaaaattggtggtattgttctgtttcatttttgttgttcttcttattatcctcataatacataccaaatttcacatagcttagattcttgcaacatgcttctactttataggttttatctcttacctcataatgtttactcgttgcgaagtcaccactattttcagtttcaggtaaaagaggaacagggtaattatcaattaaaaggtaatcagcttcaccaaaacytgatatatctttcgtcgtaaagttttctgcattggttgttgcatcggtttttgcattggctgttgtactggttgttgcatcgggttttttagtagagaaagtagttagcttgccatcaattaaggtttctttgggtaatgttttttgttttgtttcttccgtttctttggcactaaataccccaaaaacttttttgtcgccagctaaaaactttcctcctaattcttcaccgttaggcccataaaaaccaccttctaatgttccctctctggtaaagggatgttcttcagaatctttttcggttggctttactttacccctgaatctattactataaatattggcatctatatcatagagttttttcttttcatagttttgattattagtttttcttttggtgtaaaacagttctcctttcagttttttagtcccaaaatctgcactaaattgacttattaatcccgtctcaccattattttgatcattttctaaatcaatgtcttctgaaattgcactacgtcgagaataaccttgaccgctagaattactgaacaaagaataatttttgcctctttcagttgcggtgatgaagctccaagttcctttatacgttssttcgccatttacaggtaatgtagtggctgtttgcttgccaaagtaatacgcatatccatagtaacctgaataaaacttgccatttgagaaattacgccacgattgaatataataaagacccgaatatacatattgctgtccatgatgattttggggtgaatttgtttcgctaggctcgtctattgagccaatagtgggttcctgagattgattttcttttttaaaatcatcttcaatcttagaaagtgaggaaaatatgatatagccatcttcatttaagagactaggttctctaccacgtaaattctgagcaactaacttcatccctccccctaaagaaggaatggacaacttttccaaattagatttttttctttgattcgaggtatcgtcttgataacgtggtttagaagaggagggattagagacgtcatctacatcaaaagaaccacctcccccgctacaagcacttaagaaaagggaaagtccaccagagataagaggtacagatttcatagaattatattcttatacaaaattgataattgttcgcattatcattttttttttgtaataatgtcaacttataattttttaagttcatggataaaatatgaaaaatggcgtaaaacaactttttctcttatcattaataggcttatcattaacgaatgtagcttgggcagaagttgcacgtcctaaaaatgatacattgacaaatacgattcaaagtgcggaattaaaaacctcctctttttcctctatgcctaagaaagaaataccaaataggcatattatttctctttccaaaagccaattagcgcaccatccaaggcttgttttgcgtgggttaattcctgctttatatcaaaataacactcaggcagttcaactgttattaccactatataaacaatttcctcaacaagataatttcttactaacttgggcaaaggctattgaagctcgtgaacaaggtgatttaactcaatctattgcttattatcgtgaattattcgctcgagacgcatctttactacctttacgttattaattagctcaagctctattttttaactatgaaaatgaagctgccaaaattcaatttgaaaaattacgtacagaggtagatgatgaaaaatttttaggtgttattgatcagtatcttttaacactaaatcagcggaatcaatggatatggcaagtaggattaaattttttaaatgatgataatttgaataacgctccaaaaagtggcacaaaaattggtagttggaccgcttgggaaaaagaaagtgggcagggggtagggtattctttatcagtagaaaaaaaatggccatgggcagatcatttttttagtaaaactatgtttaatgggaatggaaaatattattgggataataaaaaatacaatgaggctactgtgcgtataggtggtggtttaggctatcaaactgcctcagttgaagtctcgttgtttccttttcaagaaaaacgctggtatgcaggcggtagctctggaacgaatacaatgaagcaatatgcggataaattgggtattcgtttagaaaacgtagattggctaagtaaaacttggcaaatttctaccgcacttgagtatggagaatctcgttataaaatccgaaaacatttagatggtaattattatttcgtttcatcaacattattttatttacctaaaagcacccaattttggtttgttggcatggattttcatagagaaaatacacaagcattagataatgcttatcaacaaaaaacattgagacttggttgggggcaggattggttttatggtatttcatcacgtcttacttttagttatgccaaccgagtgtatagagagaaagatttgattggtatacagcaaaaaaatcgtgaatacacaaccacaattactttatggcatcgaaatatacattttatggggctaacacctaaattatcgtgggattatcaaaaatccaccagtaatcatgctttttatcgttatgataaaaatagaatttatctcgaaattggaaaaatattttaaggctgaaaagttgtaacctaacttttgaggtatctctaactttagcaaagtgcatatattttttaatattcgtttgaagttttttttaaaaatttccgtttcttatttgacgaacgcgtattttatgactagaattgcgctctattttattcactcttaattgtatttaggtaaattaaaatgaaacgtacatttcaaccttctgtattaaaacgtagtcgtactcacggtttccgtgctcgtatggcaactaaaaatggccgtcaagttttagcgcgtcgccgtgctaaaggtcgtaaaagtttatctgcataatcacaattcacaattcttagtggttaagctgaacttttcaagggagttacgtttattaactcccattcaattcaaaaatgttttcgaacagccattcagagctagtactcccgaaattacaatccttgctagaaaaaataatcttgaacatccgcgtttaggtttgaccgttgctaaaaaacatttaaaacgcgcccacgagcgtaatcgaattaaacgcttagtacgagaaagttttcgtttatcacagcatcgtttgcctgcttatgattttgtttttgtagctaaaaatggtattggaaaactcgacaataatacatttgcacaaatactcgaaaaattatggcagagacacattcgcttggcacaaaaatcttaattaagattatccgtctttatcaaataatgattagtccgtttattggggctcgttgtcggtttgtgcctacttgttcttgctatggtattgaagcattaaaaacacacggattattaaaaggtggttggcttacgctgaaacgtgtattaaaatgccatcctttaaacgcaggtggattcgatcctgttccaccaaaaaccaataataatgatgagaaaaaataatggactcaagacgtagcctattagtgcttgcactgatttttatttctttccttgtttatcagcaatggcagttggataaaaatccacctgtgcaaactgaacaaacaacttcaataactgccacttctgacgttccggcaagttccccttctaattcacaagccatagctgattctcaaactcgtggtcgtattattactcttgaaaacgatgtgttccgtttgaaaattgatacattgggtggcgatgtaattagctctgaattattaaaatatgatgcagaattggattcaaaaacaccgtttgaattattaaaagatactaaagagcatatttatattgcgcaaagtggtttaattggtaaaaacggtattgatactcgttctggtcgtgcgcaatatcaaattgaaggcgataattttaaattagcagagggtcaagaatctctttctgtaccgcttctttttgaaaaagatggcgtaacttatcaaaaaatctttgtgttaaaacgtggtagctatgatttaggcgtagattacaagattgataaccaaagtggtcaagccattgaagttgagccttatggtcaattgaagcattctattgttgaaagctctggtaatgttgcaatgcctacttatactggcggtgcatattcttcttcagaaactaactataaaaaatatagttttagtgatatgcaagataataatctttctattgatactaaagctggttgggttgcggtgttacaacattatttcgtttctgcgtggatcccaaatcaagatgtaaataatcaactttatacaattacagatagtaaaaataatgttgcatcaattggttatcgtggttctgttgtcactattcctgctggtagccaagagacgattacaagttcattgtggactggccctaaacttcaaaatcaaatggcaactgtcgcaaataatttagatttaactgttgattatggttgggcttggtttattgctaaaccgttattctggttattaacctttattcaagggattgtgtctaactggggtttagcgattatctgtgtaacaattgtagtgaaagcaattttgtatcctcttacgaaagcacaatatacttcaatggctaaaatgcgtattttgcaaccgaaaatgcaagaaatgcgtgaacgttttggagatgatcgccaacgtatgagccaagaaatgatgaagctttataaagaggaaaaagtaaatccacttggtggttgtttgccaattcttcttcaaatgccaattttcatcgcattatactggacgttcttagaagccgttgaattacgtcatgcaccattctttggttggatccaagacttatcggcacaagatccttattacattctccctattttaatgggtatctcaatgttcttgttgcaaaaaatgtctccaacaccagtaactgacccaacacaacaaaaagtaatgaattttatgccattagtttttatgttctttttcttgtggttcccatcaggcttggtattatactggttagtatctaacttgatcactatcgcccaacagcaattaatttatcgtggattagagaaaaaagggttgcattctcgtaagaaatagtcacgaacaggcaaaaagaaaggcacggaatgtgctttctttattatttgatcttaatatattctgcattttgtagagatagagtttttttagtagaaacagggataagccttatccctctaaattaaaagtgcggctagattttaaagagttttttatgaaagaaacaatcgttgctcaagctactgcaccaggtcgtggtggtattggaattttaagagtctctgggcctttagcaacaaaagttgctcaagctatattaggtaaatgcccgaagccaagaatggcagattatcttccttttaaagatgctgatggcactattttagatcaagggattgcgctttatttcaaatcgccaaattcatttactggtgaagatgtgttggaattgcaaggtcacggtgggcaggttgtattagatttattactcaaacgtattttacaaattgatggaatccgtttggcgagaccaggcgagttttctgaacaagcttttttgaatgataaattggatcttgctcaagcggaggccattgcggatttaattgatgcaacatcagaacaagcggtacgctcagcattaaaatctttgcaaggtgaattttctaaaaaagtaaatgaattagttgattctgtgatttacttacgtacttatgtagaagcaagcattgactttcctgatgaagaaatagatttcttggcagatggaaaaattgaagcaaacttacgtggtattattaatcagttggaagatgttcgctctgaagctaaacaaggttctattttacgtgagggaatgaaagtcgtgattgctggtcgtccgaatgcgggtaaatcgagcttgcttaatgcgcttgctggtcgcgaagcngctatcgtcacggatattgcaggtacaacccgtgatgtattgcgtgagcatattcatattgacggtatgccattgcatattattgataccgcaggtcttcgagatgcaatcgatgaagtagagcgtattgggatttctcgtgcttggacagagattgaacaagccgatcgtattattttgatgttagatagtagcgatcctgaaagtgcagatttaagcaaagtgcggtcagaatttttagcaaaattaccctcaaccttgccagttactattgttagaaacaaaattgatttaaatggcgaacaagcaagtgaaagcgaacagggcggttatcaaatgattagtctttccgctcaaacgcatgatggtgtacaacttttacgtgagcatttgaaacaagcaatgggtttccaaacaggcatggaaggaggctttttagctcgtcgtcgtcatttagatgcgctggataaagccgcagagcatttacaaatcggtttggttcaacttacagaatttcacgcaggagaacttttagcggaagaattacgcttagttcaaagctatttaagtgaaattacgggtcaattcacatctgatgatttacttggtaatatttttagttctttctgcattggaaaataggaagcgtaaagtgcggtcattttttggcaaaatttaaatcaaaagcggcaatatttggtggtgttttgttgataggaattgctattagctggctttgtgaggatggagttttcactttttaagatgctaattttttacgtttagattataatcgggaaaattttatatttataacaagggttatagaatgttaattgaaaaaatgcacaatttaacaaactcaaagatttctaaatttatcttaggtttgattgctgtatcgtttttagttggtggaatgtctggctatctttttagctcaaatgatacctatgccggcaaaagtgaacggcgaagtaatttctcaacaagattttttaaatcgctataatcaagagtttgaaatacgcgcacaacgtgagggagaggcgtttgtggctcagtctgattctcctgaatttgttaccgcacttcgtcaaaacatcgttaatctaatgattgatcaagaattacttcgccaatatgttaaagaattaaaattaggcgtgagtgatgaaatgattaaacgtgcaatcgtgaccgatcctaattttcaagtaaagggtaaatttgataatgctgtttatcaacgaatattacaacaaaatcatttaacttcagatggttacgcttcaattttacgtgcttcgttacctcttgaacaaatacaaaatggcgttgctaacagtgaatttattgttcctgctcaagtaaaaaatagcgcagaagttttctttcaaaagcgtttagctcgtttagcaactttatctcttgcagatgaaatggcaaaacaatcagtctctgatgatgaaatcaaaacgtattatgaagctaatcaaaagtcttttgttcagccagagcaggttaaagttcagtatattgatctttctgcagataacatcagtagaaatcttcaagttacagatgtagaaattgcgcaatattatcaagataataaagcacaatttatgactcaacatttagctcatattcaatttgcaaatgaacaagatgcgaaagtggcttacgaggaattacagaaaggggcaaatttcgctgatgtcgctaaagcgaaatctttggataaaatttctggtgagaatggcggggatttaggctgggtaaatgagaatgaattaccaaaagcctttgaagatgccgcagctgcattgcaggtagggcaatatagccaaccaatcaatgtggatggcaattaccatattgtgttagtgcaagaacgtaaagcgcaaagtttggagaatgtgaaagctcaaattgcagatttagttcgtaaatctttgatggagagtcgttatttttctttagaaaaacaagcgagtgataaggcttttgaagacagcaagtctcttaatactgcagcacaagcagcaggtgttaaggttcaagagagcgattatttttctcgtcaaaatgtgccagctggattaaatttccctaatgttatttacacaatatttgaatcagatactacgaatgttggtatgaattctgaaccaattaatgtaggcgattatcacacaattattgtacgtgtgttggatcgcaaagcagagggcgtaaaaagtttagaagaggctaaaatagatattgaaactttcttaaaacgtcagaaagctgagaatgcgcttaatggaaaagcacnacaagcagtgaaaaaattaagtgaaaaccctgaatcaaaagtagatggcattaatttctcaagtgagcagacttttactttaagtgaaaataaagatcctattttaacaaatggtatattttcaattgctaaacctgaatcaagtaaagctctttatcaagtggtgcataattcaaatggcgatgtcgttgttgtcgctttgaataaggttgaacaaggcagtttaagtgaaaaagaattgtcgcaatttgctatgcaattattgcgtagtcatcaatctgaattacaagttcagttaatacaaggattacgtgagagagcgaaaattgaggtaaatgattctttcatcaatcaagatgatgaagcacaacaatagtaggttaaattataatttgagataaattctgctcaaaagtgcggtaaatttcaccgcacttttttacttttgtgcgaaaggaagttaatgatgttcgggaaaaaaataattcattctaaaacaatatggttttattttttattgtttctcttttccatatttaccaatatgggattaggcaatgtattaagtgagaatattcctgtttcagattacgcaattttatttgttatcacggcgatttctttttattttaccccttggcttgggcgaatattaatcactgtattattccttagtgcgttattttattgctctgctggttttttctatggtattccatctttgggtattattgcttctgtttatgaaacgaatattaatgaaaccttggaatactacacgactattcctttttggatatttttatttcaagctagttatttcatcctgtttgttgctttaatgaaattaagttttcatgttaaacaacaagcatttaaatggctaaatacggctgttatcagcctattattagttttttcttacaatcaattttctgattggaactatgggtataaattccgtttttatcccgttcttttttattctgaatttgatcgaatgaatgatctgtatttagaacaacgtgattttctaaatcaatccgctaatgcgccttctcaatgggatattcaatcttttatgccaaaatataaaaattatattttgattatcggtgaaagcatgcgaaaagattatatgtcgttatatggttttccattgaaaactacaccatttttagagcgtgtgaaaggcacagtttttgaaaattattattctgcggcaccgaatacgcaaccatctttacaactcaccctatatcgagcagaaaaaggggaaacggtttatacggataatattatttctttagccaaaaaagcgggtgtgaaaacctattggatttctaatcaaggcaaaattggggaatttgatacgatagcatctcgtattggtcaaagtgcagatgaaacgatttttatgaagccgttaggttataactctaaaaaagtttatgacgatgaaatgttgcctgtattagataaagccttaaaagaaaatattagcaattcaaaattaattgtgattcatttaataggctcacatcctgctttttgtgagcgtcttccatacgaggttaaaaattattttattaatcaatcgatgtcttgttatttagaatcgattaaatatacggatcagtttttagaaaaattaaattcacaattggtggcacaaaatgaaccctattcggtgatttacttttctgatcatgggcttgctcattatgaggattctaacggcctatcattgcatccaaataatctttataaacaagattatgaaattcctttcataatgttttcgagtgatagtcaaaaggtagaaaaaataaaaacgccacaatcggcatttaattttgtttatggttttgctgattggatgggaattaaggaaaaacatttacaaggcgtggatttcttccatcctgaaaaacaggaaattaaggtatttgattggaataacgttgtaaatgttaaagagttggctgatgatccagcaaaattaccagaaaccgttcagtaaatgagatcgtgctttatcatttatcggcttgtgctagaatgagcggaatttttttaaaagggaaatagtatgtccaaaaaatcagggctttcgtttttatggttaagtgcggtcgcttttgtgattgatttgctcactaaatacattgtggtacaaaaatttgatttgtatgaaagtgttaatgtgctgcctgttttcaatcttacctatgttcgcaattatggtgcggcatttagtttcttagcggatcatagtggctggcaacaatatttctttattttgttggcattggctatttcaggcatgttggtttattttttagcaaaaaataatgccgaacaaaaaatccaaaattctgcttatgcactgattattggtggtgcattagcgaatatggtggatcgtgcttataacggttttgtcgtggatttctttgatttctactgggatatttaccattatccagtgtttaatatcgccgatatcgccatttgtattggtgcagggttattagtattagatgcgtttaagagcgaaaagaaaaaagtacaagataaacaagtagaaaagtgcggtcagaaatgaagataattttagccaatccacgaggattttgtgccggtgtagatcgtgccattagtattgttgaattagccttagaaattcacggtgcgcctatttatgttcgtcacgaagtggtacataaccgatttgttgtgaacggattgcgtgagcgtggtgcgatctttgtggaagaattaagcgaggtgcctgatggtgcgatcgtgattttttctgcacacggtgtgtctcaagcggttcggcaagaagcaaaagatcgtaatctcaaagtatttgatgcaacctgtcctttggtgactaaagtgcatatgcaggttgcgcgcgcaagtcgaaagggtacaaaagcgattttgattgggcataaagggcatcctgaagttgaaggcacaatggggcagtatagcaatgaagatggcggtattttcctaattgaaaaagtagaagatattgcgcgtttgccaatgcaagaaaatgataatttaacctttatgacgcaaacgacgttgtcgctagatgatacggctgaaactattgctgcattaaaggaaaaatatcccgctattcaaggaccacataaaaacgatatttgttatgcgacaaccaatcgtcaagaagcggtgcgtgaattagcaaaattatcagatttagtgttggttgtaggttctaaaaattcatccaattcaaatcgtttagctgaattggcttctcgaatgggggttaaatcacagcttcttgatgaacctgccgatattcaagctgattggtttaatgatgtaaaaaccattgggattacagctggtgcttctgcgccagaggaattaggtcaatcgattatttctcgtttaaaaaggtttggtgcgaattccatagaagaactgcaaggtttagaaggaaatatgttctttgaggtgccaaaagagctgagaataaaagaagttaattaatactaagggcttgtcgtaaatgataagccctttgttttttcattcaaattaagaatttttgcgatcgagatcgcaaaagtgcggtcagtttcttgagggtttttgcaaggcaggaaaaaataggtgtgttgattgctgatcaacgattcatattataaggaaacctctntgaaattaatgaaaacattattcacttcggttgtattgtgtggtgcgctggttgtttcttcgtcttttgctgaggaaaaagcgacagancaaaccgctcaatctgttgtgacaactcaagctgaagctcaagtagcaccagccgtagtgagcgataaattgaatatcaacacagcaactgccagtgaaattcaaaaatccttaactggcattggtgcgaaaaaagcggaagctattgtgcaatatcgtgaaaaacacggtaattttnctaatgcagaacagcttttagaagtacaaggaattggcaaagcaacactagagaaaaatcgtgatcgtataatcttttaattttttaacctccaatgaatgccctgtttcacagggccttttttattttatactaaaaataattcaacattcatttcagcgattctagcttgagcattttcgggtaatcctttatcacagataatcgtatctagtgaactaagtggatatagtagaaatgttgctactttgccatatttggatgaatcagtaacaaggatattttttgactaaattggataatagcttttngttgacaggaattttttgctcatcaggcgtggttagcccttttaaattccaagatgaagtcgagatgaacgcaatgtcaactgaaatttgatgtagaaattgggcagcaaattctcccacagaggaacgatttgatttattaatgagcccaccagtatgcataatattacattggctattgaccattaaataatgggcaataacaaaatcattagtaattacaagtagatcgtttcgattagcgatttgttttgcgatttcaagtgttgtcgtgccagcatctagatatatagtggaatgttcttgtattaactcaactgcttttttactaatagccgtcttttcagtcgttgctagtaatgatttatcgtcatgtgttggttcactggataaacgttcaagtaattgaaccccccccgaaacagagatgacttttccatcctcttcgagcttttgtatatcacgacgtacggtcatatgcgatacgcctaagatattgactaagttatttatactaataacgctttgtttactaattaagtttaataatgtcttttgccgttcagcaggaatcatctttttctccatacctgatttcaaatcagattatgagctcataacgttttatcactaaaattaacaaaaaataacattttttatcattctgtgatctagatctcagatttaatttattgtatcggctaatatacagataaatttagttaagatctattaggagattaaaaatggaaaatcaaaattattcagtcgcagtaattggtcttggttctatgggtatgggcgcagcggtatcttgcattaatgcaggattaacgacctatggtattgatttaaacccagttgcacttgaaaaactaaaagcggcaggtgcaaaagctgtagcggcaaatggctatgacttcgctcacgaacttgatgctgtagtgattttagtggttaatgcagcccaagctaacgcagtattatttggcgaaaatggtattgctaaaaaattaaaagcaggtacagcggtgatggtttcttctaccatggcggctcaagatgctcaaataatttcacaaaaattaacagaattaggtttgattatgttagatgcacctgtttctggtggtgcagctaaagcattaaaaggtgaaatgactgttatggcatcgggttcaaaacaagcatttgagttgttacaacctgttttagatgccactgcggcaaaagtttataacattggtgaagaaattggtttaggtgcaacggtgaaaatcgtccatcaattattagctggcgtacatattgcagcaggtgcggaagctatggctcttgcctcaaaagcaggtattccacttgatgttatgtatgatgttgtgaccaatgcagctggtaactcttggatgtttgaaaaccggatgaaacacgtagtagaaggtgactatacgccgctttctatggttgatatttttgtgaaagatttaggcttagttaatgacactgcaaaatcacttcatttcccacttcatttggcaagcacagcctattctatgttcactgaggcaagcaatgcgggttatggtaaagaagatgatagtgcagtgattaaaatttttagtggcgttagcttaccgaaaaaaggagcgtagcgatgttaggtgttattgcagatgattttacaggcgcaagcgatatcgccagttttttggttgaaaatggcttaagtacggtgcaaatgaacggtgttccaacacaatcgttaaacagcaaagtagatgccattgtgatcagtctaaaatcacgttccaaccctgtgaatgaagctattgaacagtcattgagggcttatcaatggttaaaggaaaatggttgtacgcaattttattttaaatattgttccacctttgacagcacagcgaaaggcaatatcggtcctgtcacggatgctttactagatgaattaaatgaagatttcaccgttattacaccagccttacctgtaaatggtcgcactatttttaacggctatttattcgtaggtgatgtattgttgagtgaatcaggcatgaaaaaccacccgattacaccaatggtggacgcaaatttaatgcgtttaatggatgcacaagccaaaggtaaaacaggtttggtggcgtatgctgatgtgattaaaggggcttcgcgtgtgcaagagtgctttgcggaattaaaagcacaaggctaccgttatgcggttgttgatgccgtggataattcgcagttggaagtacttgctgaagcagtggcggatttcaaattggtgacaggcggttcaggcttaggagcttatatggctgcacgtttaagtggtggtaaaaaaggcaccaatgcctttacgccaactaaaggtaaaaccgtggtgctttcagggtcttgctcagtaatgaccaataaacaagtggaaaaatatcgtgaaaaagcaccgcactttcaacttgatgttgagcaagccatccataatgaaaattatatagaacaactttatcagtgggtaatagcaaatctcgatagcgaatttgcccctatggtctatgcaacagtgccaccagatgcattaaaagctattcaacatcaatttggggtggatcaagcaagccatgccattgaaaacacgtttgctaaattagccgcgaagttaaaacaatatggcgtaacaaactttattactgctggtggtgaaacctcaagtattgtggtgcaagaacttggttttactgggttccatattggtaaacaaattgccccaggtgtgccttggttaaaagcggtagaagaagatattttccttgcgcttaaatcaggcaatttcggcaaagaagacttttttgaatatgcacaaggaatgttcctatgacggatttagcacaaaaagaattaatggtgcagctcggacgttctttttatgagcgaggttacaccgtgggcggtgcaggtaatttatcagttcgcttagatgacaatcgtgtgttagtgacccctacaggttcttcactcggtcggttaagtgtagaacgtttatctgtattggatatggaaggtaatcttttagggggcgataaaccatcgaaagaagcagtatttcatttggctatgtacaagaaaaatcctgagtgcaaagccattgtgcatttacatagtacctatttgaccgcactttcttgcttagataatttggatcctaataatgctatagagccatttacaccgtattacgtaatgcgcgtgggaaaaatgcaagttattccctactatagaccgggttcaccaaagattgcagaagaattaagtaacagagctttaacaggcaaagccttcttactcgctaatcatggtgttgttgtcactggctcagacttgcttgatgcggcagataatacagaagagttagaagaaaccgcaaaattattcttcactttgcaaggacaaaaaatccgctatctcactgataccgaagtgaaagatttagaaaatagaggaaaataattatgcctaaatttgcagcaaacttaacaatgatgtttaacgaagtgccatttttagatcgctttgaagcggcggctaaagcaggctttaaatatgtcgaattcttatggccttatgattaccctgcacaagaactcaaagcaattttagataagcatggcctaaaagttgtgttatttaataccccagctggtgatgtaaacaaaggtgaatggggggggtcggcaatccctggccgagaagctgatagccatagagatattgatttggctcttgaatatgcacttgcattaggttgtccaaatgtacatatcatgtcagcagttgtgccagaaggtgcaagccgtgaagaatataaacaaacctttatcaaaaacgtacgctatgcatctgataaatataaaccatatggaatcaaaattcagcttgaagctttaagccctgaagtgaaacctaattatttactcaaaagccaatttgatacgcttgaagtggtggaattggttgatcgtgataatgtatttgttcaactcgactattttcatgcacaaaatgtagatggcaatcttgcacgtttaaccgataaattaaatggcaaatttgctcacgttcaaattgcttctgtaccagaccgtcatgaacccgacgaaggtgaaattaactaccaatatatcttcgataaactagatgaaatcggttatacaggctatgttggctgtgaatacaaaccacgtggcgaaaccgtaacgggattggattggtttcagaagtataaataaatattcttaaatttaactgcggttttaaaaacacatattatctaaggnggataaaatgaaagttgtaattactggtggacaagggttcttaggacaacgtttagccaaaacgctattagcccagaataatgttcatattgatgatttaattttaattgatgttgttaagcctattgcgccaaataatgatcctcgtgttcgatgttatgaaatgaatttacgttatccaacaggattagatgaattaattactgaagaaacggatgctatttttcatttagcagctatcgtaagtagtcatgcggaacaagatcctgatttaggttatgaaactaatttcttagcaacacgaaatatccttgaaatttgtcgcaaaaataatcctaaagttcggtttattttctctagttctttagccatatttggtggagaactacctgaaactattttagacagtacagcattcacaccgcaatctacctatggtacacaaaaagcaatgtgtgaattgctgattaatgattactcacgaaaaggctttgtagatggtattgttgttcgtttaccaaccatttgtattcgaccaggcaaaccaaacaaagctgcatcctcatttgttagcagtattatgcgtgaacctctacatggggaggatgccgtgtgtcctgtatcggaagaattacgtttatggttatctagcccaaatacagtagttgcaaactttattcatgctttacaacttccatcacttccattgcgtagttggcatactattaatcttccagggtttagtgttaccgtaaaacaaatgttatctgatctcactcaagtaaaaggtgaagcaattttagaacatattaaatttgagttcgatgaaagcattaacaatatcgttgctagttggccttcaagaattgataacacccaggcattagctcttggtttcaaagtggatagcaatttccaaaatgttatccaacagtttattgaatatgatatgtaggaggcactatgtttggcttaccgattccaattattggattattaatcgctgtatttgttctcgtttttctcgtattaagaacgcgagttcatgctttcatcgcaatgctaattgcagcttcaattgcaggtttagtaggtggtatgtcagctgatgaaaccttaaattccatcacaaaaggatttggtggcacactaggtagtattgggattgttatcggacttggtgtaatgatgggtagcgtcttagaagtttctggtgcggcagaaaaaatggcatatagttttatcaaaatgctaggtcagaaaaaagaagaatgggcattagctattacaggttacgtagtgagtattccaattttcgtagattctgcatttgttatcctttatccagtagcaaaagctctcgcaaaaaatggtaaacgctcattattaactctaggcgttgctttggctggtggcttggctgtgacacaccacaccgttccaccaacaccaggtccattgggagtagctgggttatttggtgtagatattggtgcaatgttactcactggaatgtgtatggctttcttgcctgttgtaggaatagttctgtatgctaaatggttagataaaaaataccctaactttaatcaagaagtgttcacggaagaagaattaaaacaaaaatatgatagttatattgaaagtcgtgagaaaaaagaacttcctagtttagggctttctttactaccaattgtattaccgatagtattaatctttattaaagcagttgtacatttattcgttaaagatgtacctgaagcattgacaagtataccttatcaaatcgtttcattccttggtcaccctgttattgttttagcattaagcgtattaatttctgtttacacattattaccaaaagccgataaaaatacgactgcacttcatcttgaagaaggtgttaaaacagctggtattatcttattagtaacaggtgcgggtggtgcattaggtgcggtattacgcgatagtggtgctggaaaacaattagcagaacagatcgcaaacttacctatttcaccaattttaattccatttatcgtatcgaccttagtgcgttttattcaaggttcaggtacggttgcaatgattacagctgcttcaatttcatccccaatccttgcacaaatacctggtgtcaatatgctattagccgctcaagctgctaccatgggatcgcttttctttggctatttcaatgatagtttattctgggtggttaaccgtatgatgggaattaatgatgtgaaaaaacaaatggtcgtttggtctgtaccaaccacgattgcttgggggattggtggtatttcagtaattctggctaacttgatttttggcaacgatggctctgtatttgatctgcttttccctgttgtcgtgttagccagcattttattctatatcaaacttcagaataaaaatctttaattacggttaaaatttaatagtgatacgttgtacagatataaatgagataacaccatttagcagttttatctctaaaataccaaatcattgcggtacacatatggatgcgtcacgccactttgtaaaagatggtttaagtatcaatgaactgccaattgggtatttttgccataaggatgttgtattacttgaagttccaaaaggagaagcggaagggattacgaaagaagatttagagccttatgcggctattttagcgcaagtatcgtttgctttcttgtgcacagggtttgagaaatacagaactgagaatccgttaatttatcaaaatgaaggaccatatattgcgactagtgcgggaaaatatttatccgataactatcctaatttaaaaggagtaggtatttggtttccttgcacttggttcgccgtcttctcgtgtacctgatacagaaaatccgaaaaattgccaccaagcgatcttaggttatcaatgcaccattacgcattgtcgggctagattcaagccaacttgtattgctgaaattgaataaatgatggagtgctagggttatctctagcactctttttatatctagataggagtgaagattatgtaaaatatcaacctttatcttggtgaacttgtgggaacagcattttttatggtgttaggacttggcgtttgtgccaatatttccttaaaaaaatcaggaatgtatgggaacggtggtttacttaccgcttgtggtttggattatcaatggtgtccattgctgttatttttggaccactcaccggcgctcatgtaaatcctgctgttactatcgatttttgggaggtaggtaaatttccaacagaacttgtgttagtctatattattgctcaatgtatcggtgcgtttattgttgctctgattgtatggctattatttaaagatcatttagatgaagaagacaatcaaaattgtcaattaggttcttttgccactattgcaacaaactctaataacttacgcaatttactttctgaaattgtcaccacattttcattgttatttattttattcacactaaatcatcaacaacctactaatggtgttgcaatgttctttgtttttacgggagtagctggtggtgttatgtcctttggtggattaacgagttatgcaatcaacccagcacgtgattttatgctgcgtcttattcacgctatcatgccaattaaaaataaaggtacttccaatttcgattacgcttgggttcctgtcttgaggcctgtaattggtgcaatattagctgcttggttatacaaagcattgttttagttttaatgtgggggaagataaggatgtagttaaatgtgttatagttttggggctgacgtagattagccctaaataccactccattttcgcaatgttttaagctgttcttttggcactccaaagttaaaccgaaattcacattccttcaagaataaaggaaagttttttcggtcgattccattatattttcggaggattctcttcgcctgactccagaaattttctattccatttatgtggttttgtttcaccgcaaatagttcggaatgattgattcgttcgtggtgaaatttgctcgcatcaagggcatcatagcttcgataagtatcggtataaacccagctgtcaggcttgatttttctcacaataacaggcattaatgtctctgttttgtattttctaccactactgtaaatatttttccttgtcgctttaacaaaccgaatacagcaacttttcctgctgcacctcgacctcgttttcctttatgatgaccgccaaaatagctttcattaagctcaatttgatcatcaacaacctcatcggcttcaagggctaaatgatagctaatgacttcacgaatttttctataaaaaaatcgctgaattggcttagatatcgagtaaatcagccgctgctcgggctgtaacttctaatacaaaaaattcaagtagcttattttgtatagatttctttaatttacaatgagttatcttcatttttatagactagtgcacttgctaatctacgtcagcccctttattttttcagaaaatgtagaaagtttatttctttttaaaaagccgttggcaatcttagtaaattttaatacactagaaagcctagtcggggtgcaatacgctgagatcatacccgtgaacctgaaacagttaatactgacgtaggaaactaggaatataaccttatctccttttcgtcattattgctgccttttaatcataaataaggatgtaataatgaaacttcttaaattaaccttaatttctaccgcacttttttccaccgcagcattagctcaagcacagcaaagtgtaaacgtatatagctacgactctttcacttctgaatggggggctgggccaaaagtaaaacaagattttgaaaaagcccatccacaatgtgcgattaattttacgccttttgaaagcgttggtgtgttgctcaaccgtgttcgtttggaaggaaagaaaacaaaagcggatattgtgctaggtttagataacttttttttggaacaagctgaaaaaacaggtatttttgcgccaaataacgtggatttaactcagctggatttaccaacaaaatgggcgaataaaaccttcttaccttttgatttcggtaattatgcttttgtgtacgataaaactaaattacaaaacccgccgaaaagtttgaaagaattagttgaacgtcaagatcttagtgtgatttatcaagatcctcgcaccagcagtgtgggtcgtggtttattggtttggatgaatgctgtttaccctgctgataaaattcaatccgcttggaaagagttagataagcatacagtgacagtgggtaaaggctggtcagatacttacggtgcatttttgaaaggcgaagcggatttagtattaagttacagcacatcgccactttatcatcaactttttgagaaaaaagataattatgcggcgacagattttgcggaaggtcatattactcaagtagaattagcggcgcgagttgcaaaccatccaaatcaatgtgcggatgattttatggcatttttaatttcgcctacagcacaaaaacatattgtgaccgcgaacattatgttgccagttattcaaggcgaaattgaaccgcactttgatgcacttaaagttcaacaaaaaactcaaacgtcaattaatccaatggtgaatactgagcagttaaaaaattggatcagcacttggcaaactacattaacaaaataatttgatgttttcgttatttcatcatccacaacttcgccctcgtcattatgcgggcggggttgttgttattagtttcattattcttttttatggtggtgccttaagttcgatctttgcattgggcggtgaattgcaatggcgagcttggtttactgatgattatctacagcatttgattcttttcagttttgggcaagccttactgtctaccgttttatctattttctttggtttacttctcgctagggcattattttataagccatttttgggaaaaaagtggttgttaaaattaatgtcgctaacttttgtcttacctgctttagtggtaatttttggtttgatcggcatttatggttcaagtggttggttagcttggcttgctaacctttttggaatgtcgtggcagggacatatttacggactttcgggaattttaattgcccacctttttttcaatattccactggcagcacagcttttcttacaaagtttgcaaagtatcccttatcagcaacgtcagcttgcagcccagcttaatttgcaaggttggcaatttgttaaattggtggagtggccggtttttcgtcagcaatgtttgcctacattcagcttaatttttatgctgtgctttaccagttttactgttgttcttacattaggtggtgggcctcaatatacaacattagaaacagcaatctaccaagcgattttatttgaatttgatctgccgaaagcggcactttttgctatgttgcaatttgtattttgcttgattttatttagtttgacatcgcgtttttcgctttctaatcaaaatggcttgagcaatagtaatatttggtttgagaaacctaaaagtgcggtcaaaattttccatattttggttttacttgtttttgtctttttccttttttcgccagtattgaatattcttattagcgcattgagttcatcaaatttactcacagtttggcataattcccagctctggcgtgccttaggctattcactttctatcgcgcccttgtccgcattacttgcattaacgatggcaattgccttattgcttttatcacgccgtttagaatggttgcattatcaaaaaatctcacaatttattattaatgctggaatggtaattttagccatcccgattttagtgcttgcgatggggttgtttttattattacaagatcgtgatttttccaatattgatttgtttatcatcgttgtattttgtaatgccttaagtgcaatgccttttgttttacgtattttaagcgcaccttttcataacaatatgcgttattacgaaaatttgtgtaatagtctgggaattgtgggttggcaacgtttttatctgattgaatggaaaactttgcgcgcaccgctgcgttatgcttttgctttaggtttagcgttatctctcggcgattttacggcgattgcgttatttggcaatcaagagtttacttctctaccgcatttgttatatcagcagctagggaattatcgtaatcaagatgcagctgtaaccgcagggattttattattgctttgtggcatattgtttgcctttattcacacatatagggatgccgatgatttatctaaataatgtgattttgaatgataaaaccttaccgatgtgctttaatttgagcgtaaatgctggagaacgtgttgcaattattggcgagagtggcgcggggaaaagtactttattgaatttaattgctgggtttgaatttcctgctcaaggagaaatttggttaaacgataaaaatcatacgcgtagtgcgccttacgagcgtcctgtttctatgctatttcaagaaaataacctatttccccatttgactgtacaacaaaatcttgccttaggaataaaaccctctttaaaattaaccgcacttgagcaggaaaaaattgaacaggtcgcttgctccgtaggattaggcgattatttagagcgtttaccgaattctctttcgggggggcaaaaacaacgagtggcattggcgcgttgtttgttgcgagataagccaattttgttattagatgagcctttttctgcattagatcagaaacttcgggtagaaatgctggctttaatcgctaaactttgtgacgagaaagatttaacattgctacttgttacccaccaaccatcggaattaatcggttcgatagatcaagtgttagtggtggaaaatggtcagataagtcaattacaaaaaggggtgtaaaattagtttcattcataacgttgaattgattgtttctaccatatacactaattcatcaattaagaaagtataaaaagcgtggtgtttttaaccgcactttcaaaggaaaaacatgttagcggaaaaattacaaattaactctattacacctcatccaagtgtagaatattggtctgtttgcaaagttgaggcgttatttgaaacgccatttttggaattagtttaccgagcaacgcaagttcatcgtaagcattttaatcctcgcgcgattcagttatccacgttaatgtctatcaaaacggggggatgcccagaagattgtagttattgccctcaatcagcccgttatcatactggcgtacaaaatcagcagttattagatgttgatgagatcgtcgctaaagcaaaaattgcgaaagcacgtggtgcagggcgtttctgtatgggggctgcttggcgaggccctaagccaaaagatattgagaaagtcacagaaattattaaagccgtgaaatcacttggtttagaaacttgcggtacctttggtttattgcaagacggtatggcggaagatttaaaagaagctggattagattattacaatcataatcttgataccgcaccagaaattatgcagaagtgattggtactcgccgttttgatgatcgccttagcaccttaggaaaagtgcgcaaagctggattaaaagtgtgttgtggtggcattgtagggatgaatgaaactcgcaaagaacgggctggattaatcgcgagccttgcaaatcttgatccgcaacctgagtcagtgccgattaatcaactcgttaaggttgaaggtacgccgttagccgatgcggaagaattagattggacggagtttgtgcgaacgattgctgttgcacgtattactatgccaaaaagttatgttcgcctttctgcaggtcgcagtggtatgactgaagaaatgcaagcgatgtgttttatggcgggtgcaaattctattttctatggcgataaattacttgttacagataatccagaagaagatggcgatcagttattgatggcaaaattagatttagagccagaaactgcagaaaataaaaagttgtagtttgcgttagaaagctgagaaattaagtataaatctattcctttctttatttcatatctcacaataattttcaatagccaataataaagctccttgaatatcaaggagctagtttagtttaatcttaaagaatttctttcgcttttgctaccacgttttcaacagtgaaaccaaagagtttgaataattgatctgctggtgcggattcgccaaagctattcataccgataacacgaccattgaatccaacgtatttataccagaagtcagcaatacccgcttcaatcgcaacacgtttggttaccgctgcaggtaatacactttcacggtacgctgcatcttgtttatcgaaacggttagtacttggcatagaaacaacgcgtacttttttaccttcagcacttaatgcttcggctgcttgcactgctaattccacttcagaacctgtcgcaatgaagattaactcaggtgtgccatcacagtcttttaacacataagcaccacgtttaaccgcatctaattgtgcagaagtgcggtccatttgggctaagttttgacgggtaaagatcaacgcacttgggccatcttgacgttcaaccgcttgttgccatgcgatggctgattcaacttggtcacatggacgccatgtttcaaggtttggaattaagcgtagtgaagccgtttgttctactggttggtgtgtaggcccatcttcgcctaaaccaatggaatcgtgggtataaacgaataatgtgcgttgtttcattaatgctgccatacgcaccgcattgtgagcatattcgtagaacattaagaaggttgcgccgtaaggaatgaaaccgccgtgtaaagcaataccgttcataatggcagacataccaaattcacgaacgccgtagttaatgtagttaccacctacgttttcgtgggcacgaattggtttagaaccactccataacgttaagttagagcttgctaagtctgcagagccacctaagaattcaggtaatacgtgcgcataagcttcgatagcattttgtgatgctttacggcttgcaatactcgctggatttgcttgtaatttttcgatgaacgctttagattctgccgcccagtttgttggtaattcgccagaaacacgacgtttaaattctgctgctaattcaggataggcttttgcataagcggcaaatttttcttcccaagatttttctgctgcagcacctttctcttttgccgaccattcagcatagtattcagctggaatttcaaatggcgcatattcccaaccaagtgctttacgggttaaatcgatttcttcatcgcctaatggtgcgccatgggaatcatgagaacctgatttatttggtgaaccaaagccgatgatggttttacaaataattaacgttggttttcctttttctgcttgagcaagaatggtagcagcacgaatttgctctgcatcgtgaccatctacattacggattacttgccagccataagcttcaaaacgctcggcagtgtcatcactgaaccagccatcaacatgaccatcaatggaaatattgttgtcatcgtagaatgcgattaatttacccagacctaaggttcctgctaaagagcaagcctcgtgagaaatcccttccattaaacaaccatcgcctaagaacacataagtgtggtgatcgacaatttcatggccttcacggttaaattgtccagctaaggttttctcagcaattgccatacccaccgcattagtgataccttgacctaacgggccagtcgtggtttcaacaccaggggcataaccatattctgggtgacctggggttttagaatgtaattgacggaattgttttaaatcttcgatagaaagatcatagccagttaaatgtaaaagactataaatcaacatagaaccatggccgttagaaagtacaaaacgatctcgatcagcccatttaggattggttggattgtgttttaaaaagtcgcgccataatacttcagcaatatccgccatccccattggtgcaccagggtgaccagatttcgctttttgtacagaatccattgctaagacacgaattgcattggctaattgtctacgagttgccattttgttctcctgtgaatattttgttattttcctaatcttgaccgaaagtgagtgcaaatacttgtaacaatatcttgcaaggttactatgtgaaaattaggtggcagctattttatactattctgcctttatatccaaaattgccctattttctgttttaattgctctgctatctctcgacctgatttaccaactaatgctctacccgcaataaacgctttcaaattttttgtatttttaaacaaatggagatcgtcaggagtaatacctcctgtaatagataattcgatacctaatgaatctaatttttctatattttcaatatcttgatttgaccaacttaaaccagataattcggcatctcttgaacggtgatagatggcttgtttgataccaagttgaagccagttttttacttcatcaaaattccaattaccataaagttcaatttgaatttcctttggtacaccaagattaggttgaattttgttaaattcttctgctactttttggcaagctgcttttgttgctggatgagctgctgctgatacggtaagccaatctgccccagcttcaaatgccatttttgctaaagtagcacctgcatctgttgttttaagatcgcaaacaagaatttgattaggatataacgcacgtaatattcgcactgcacgcattccctctgaacatgcaagaattgttccgacttcaataatatctatattatgttcaatctgttttacatcaactaatgcagtctctaaatattgggcatcaagagcgatttgtaataaaggttttcccatcgtttttccttaaataatatgaggaaggcagtataattctgtctttaattcattgaccataataggcattttgaccatgtttgcgtagataatgtttatccaatagatctttttgcataggagatagataaggattaagttgctgagaaaataagttcatataagcaacttcttctaaaacaacggcattatgtaccgcattatttgcatcttttccccaagcaaatgggccatgactatgcactaataccgccggaatattatcaggttcaattcctctcgaaagaaaagtttcgacaatcacttttccagtttctaattcgtaattaccttttatttcctttgttgtcatttgacgggtacaaggaatcgtaccgtaaaaataatcgccatgtgtagttcccacctcaataatatctaagccagcctgagcccaaattgtggcatgtcgagaatgtgtatgaacaataccaccaatatgaggaaattgtcgataaagctcaagatgagttggtgtgtcagaagaaggttttttattgccttcaacaatatttcctgtaaataaatctacgacaaccatatcattttctgtcattacatcataatctacaccagatggtttaatgacgactaaatttttttcacgatcaattgctgaaacattaccccaagtaaaagtcactaaatgatgtttgggtaatgctaaattggcttcaaaaacctctttttttaattgtgctaacataataatcctgccttttccatttgttgaactatccacttacgagcttgaataatttctaataagggttcttcatttttttctgtccacatttcaattaagaatgcacctctgtaattcaatttttttaataggctaaaaaaatgaacaaaatcaacacatccttgaccaaaaggtacatctctaaattgtcctttacttgtttcagtgacggggtaagtatcttttaaatgaatagctgatattttatctatgcctaatgtaagttcttcttcaatattattattccaagcacttaaatttcctatgtctgggtaaacggtaaaccacggagaattaatgatggtatcccattttttccaacgagaaatagaactcataaaaggcgtatccataatttcgaccgcaagagtaacttgagctgatgcagcaagagttacagcgaattcaataccctcctgaaaatatttgattgtttcttcatcttgtttttcgtaatacacatcataacctgctaactgtatggttctaatgcctaaattcaccgaaagatcaatggctttttccataatttcaaaggatttttgacgaatttttttgtctttactaccaaaagggaagcgacgatgagccgacaagcacatagaggggatagttattccactttgaataatagattgatgtagagctattctttctgattttgtccagtttaaacgagataatctgtcattgctttcatcaatagacatttcaataaattcaaagccacatgctttagcgagagataaacgctcttgccaagtaatatttttcggtaatgctttctcataaataccgattttatgttttttcataacttttccttttttagtctaaattttttaatgcttcaataaactttaaatagcgatgatatttatgctgatacttactatattgatttttatcaggtaaaaatattttcctatcaatatttaatatttgagaaatttcaaccgcactttcggcttgcatcgccatcaatgctgcacctaagcaaccagtttcttcaatattagggatttctagtctcataccacttatatccgcaagcatttgcatccaaacttctgattttgctggtccaccagttacgcgaagcgkgcttgcattaggaaaacgtacttgcattctttctaaatgagacattaggctaaatatcacaccttcataaattgcttggagtaaatgtatttgggtatgatgagattgaattccataaaaccctgcttgcatacctaacttagcattagagccatataaaaaaggtgcaaataagactgagctacttgcgggtttaagttttgcaatttcgtgattaatgtcatcatagttaggcaaattaaattgatttacaaaccactctaaattacctgctgatgttggacttgcttcatgaataatgaatttatttttttctggatatttgccatacacaaaaggaattgtttggttatcatcaatataatgggtcaccccactaacaacagaccacgtccctaatacaacattaagatgttgatcatccttcaaatcagcgcataatgcagtggataccacatcaaataatcctccaacaacaggtattccttctaccaaaccagattgctctgctgctctggaggttacatatcctgcaattttatttgatttaatgattggaggtaatttatctatgcattctgttataccgaataacttagctaactgaatgtcatattttccttctcgcatattgtaaaaattagactcagaaatatttgtttcttcacaatataatttttcagttaaacaaaatcgaaggtaatcgtgagacattaaaatcgtatgaatttgctcatatcgactgggttcattttcttttatccagcgtaaaatcgagacaggatgtcccatccaaagagtttggagtgtgataggataaaatttttgtagtatgttttctttttgccaacattgcacaatttcgtatgcccgttggtcagatgataagattgctcgccctaatggtttattatctttatctaaaaaaaacgcacctttaccttgtgcagaaatgccaatagcttttatttgttgaggcaaaatactactttgtcttatagttttctgaataacttgcgcgcaaagattccataattcatccatatcccgttcagcataaccgggtttttcactaataataggaatatttctgcgtgcaatactttgtagtgtaccattttgatcaaaaatcgctgcttttataaacgtaccaccacaatcaataccaagatagtaatgcatatattctccttagttttttatgggctggatttttattatgtaaaatccagcctattgactattccgataatgcatctactttcttcaataaatcatcgccatgtttttcaataaagcttttgcgaactttttcttcaatcaaggttttaaagggctctgtattgattttttcaatgacttcaactccttgtttacgtaatttactaataatattttgttcgttttttacattaagatctcgttggaattgtccagcttctttagctgcttctataatagctgtttgtaaagctggtaaaagtgaatcaaattttgctttattcatcacaacaatgagaggtgtatagccatgattagtcaaacttaaatatttttgtacttcatagagttttgaagaccaaaaaattccaatcggatgctcttgcgcatccacagctcgagtttctaatgccgtgtaaagttctgctaatggcattggaacagggttacttcctagtaatttgaatgcctcaatgtacatcggattttgatttgtccgtacttttaaccctttaatatgttcaggttttgttactgtttgtttagaatttgaaaatgcgcggaaacctacatcccaaaatgctaagccttttaatccttgtttctctaagtcttttaataaattctgtcccacctcgccatctaatactttataaacgtgttcacgatctttaaaaataaaaggaatatcaatgacatttaatttaggttctaatcctgtaaaatttggtgatccagacatttcaagatcaattgttcctcctcttacactactaatcattgtttgtgcattacctaaagtactatcgggaaataattttagtttgatttcacctttcgtttttttcatcaaaagatcattaaattttttagccgcactatgttggctatctgagcgtggcgcttcatagccaaaacgtagtgatatttcagctaatgctggagaagtaactaacgtaaaaccagcgattagcatgctaagctttttgaagttgaaaagtttcataaaagtctccttgtgttaagaaagtctgttttactggatccattgtagtggcattaaaattagttctggaataaaaataaaggtaagtaataacataatcatcatccctaaatagggcataatacctttcgcagcctgatcaaaaggaagctttgatactccagtgataacgttcaacacattgcccacgggcggtgtaattaagccaattgaggtatttaagataaacaatacgccgaaataaactggatcaattccagcttcttccacaagtggcattaaaacgggggttaaaattaagactgttggtgttaaatccattaccattcctatcacaaatacagcaagcataatgaccaaaagtaaaattgttggattttcaattaaaggttcaagcaatattgtcagcattgtgggaagttcagcaacagtaattaagtagccagttacattagctgaggcaaccaaaaacataacaactgcggtggtttttgctgcagctaacaatacttttggcaaatgttttaagggtaattcatgatatataaagagagaaacaattaatgcataaaatgttgcaactacaccagcttcagtaggtgtaaatatacctgaacgaaatcctcctataatgattactggtagcattaatgcccaaacactatttttaaaagaaaaacaaagatcttgtttcgttgcttttgaaaatgtcattaaattaaggcgtttagcttgccaccgccataaaatagctaggcaacatcccataatcacaccagggaaaatacctgctaaaaataatttagtgatagatacaccactggcaacaccaaagacaataaaaggaattgatggaggaattataggagcaatgataccagcagtgccgattaaaccagcagaacgatgtattggatatcctgtggttttcatcattggtagtaacatagcagctacagcagcagtatcagcaacagccgaaccagataagcttgccataatcattgcacttaaaatagcaacaaatcccagccctcctcgtttatgacctacaagtttcataggtaaatcaataatacgtttagaaagtcctccctcattcattatttcaccagcaaggataaaaaagggaatagccattagagaaaaactatctgcgccactgacaagttgttgtgcaagtatttgtgcattaaaaaagtctagatggagcattagtgctattccacaaattagcaaggcaaaggcaacaggtacaccaagaataatggtaccaagcaagacggaaagaaaaataatcactgtcattttacttctcctctgaatataaagaatattgtgcttatcaagcgagtaatcagtattgcgctaactaaaatgcctgcgattacacttgcaaagtaagttagtccctgaggtaatccagaaataggagcgaaattattaagattaagctgaaattgaatccaactgccctcaatgatgagatagcaacaaatcagcatcatcatatctgtaataaatttaagtatagcttgaccaaatggaggcagcttgtttaccaaaacagtgacactaacgtgttgattctcattgaaagctaacaccgcacctaaaaatgccagccaaataaagagataacgagaaatttcttcagttatactaataccactattaaatccatagcgtaaaacgacattcaaaaacactagaatggacatcaaggctaaaatagaaatacaaagtatctctagtgctttgttaataaagtgggcgagagatctcatcattacacctccaattgattatcacaaatgtgattcgttttatattatggcgttttactggaaacatattgctgttataacgtctttaattttgcccaaactcgttcatccactggaataccattagtttggttatccgaaagaatagtggtaaattcatgaccaggtaggcgaacagcttgagttggatcagatcgttctgctgtttttacataatccataatgcggtttaatttttcatctttgcttttaccatcaattaagcgatctacttcaatggcgataaacacttgagaaacacagtattcatcgtttttatcttcagttacagcaactgtcgattcaccattcgatagtaaggttgcaatcatatccagcacgatagataaaccagaacctttccaaaatcccattggcagcaaacgacggtttttttctacaatagagggatcacgagttaaatttccttcatcatcaaaacctgcatcaacaaaggtttgacgaccagctaaacgatggacttctaacattccataggaatacattgagcaagacatatccaccatagtgattggtgtggtaggaactgcaataattaatggattcgtccctatacggcattctttagctccccaagggggcattaccgctaatgcatttgtccaacagatcccgatataacctttttcagccgcttgccaaccgtaagatcctcctcgcatccagtgattagcattacgaagtgctattacaccgacaccatgttgtgaagctaactctattgctctatccatcatttttttggcagtcaaattgcctattgcttgatgtgcatcccactgttctatagaacctaaacttaatacttttgtagggattgcattgggtacaatatctccctgttcaagttgttgaataaaacgaggaaaacgatttataccgtgtgaataagcacccgcttgtgttgtgtctgtaaatgcagtagcgcattcttctgctagttcctcagtaagctgacgatctaataaaacacgcttaaactcattttttaattcatcataagaaactctcattttttcctctcttaattttatatagtaaaattacgtttcataatttacaaaaataagaaagctcagtcaataaatgtaaaataaataaattatttataaatcaatatgttaaaataattttactgattttgkgatctagatcctattttcttgtgataatatttcatattgtgaaatgaatattgaggtgaaaatggaaaaagaaaaaagcttaggtaatcaagctctaatcagaggattacgattattagatattcttagcaattatcctaacggttgcccacttgctaaattagcagaacttgctaatttaaataaaagtaccgcacatcggttgttacaaggrttacaaaatgaaggttatgtcaaaccagcaaatgctgctggtagttatcgattaaccataaaatgtttaagtattggtcaaaaagtgttgtcgtctatgaatattattcacgtggcttcaccttatttagaacaacttaatctgaaattaggcgaaactatcaatttctcaaaaagggaagatgatcatgctattatgatctataaattagagccgactaatggaatgttaaaaacacgagcttatattggccaatacttgaaattatattgctctgcaatgggaaaaattttcttagcatatgaaaaaaaagtagattacctttctcattattggcaatcgcatcaaagggaaattaagaaattaactcgttatacgattacagaattagatgatataaaacttgancttgaaacaatccgtcaaacagcttatgcgatggatagagaagaaaatgaactaggcgtaacctgtattgcttgcccaatttttgattcatttggtcaagtggaatacgctatctcagtttcaatgtctatttatagactcaataaatttggtacagatgcttttttacaagaaatcaggaagacggctgaacagatttctttagaattgggatatgaaaatatctagcataaatatcatataatancagataaaatattctaaaattaattgcactttctatgttattaaaagtaatcatacataataaaatcttcttaattatttgttaccattagttagagtaattcaattttttagcaacttacaggatttttatgcaaattcaatgtttcgaaagtattacacaaaaatacccacaatttcctaccgcacttttggctaatgaggaacctatacagaacggagagccttttatcttatacggcacaaagttggacataactaagctagaaaaatttcaacaaaagtgcggtcaaaattttcagatttttgatgtttggatggtagcgaaaaatattatcgtcttattgaaaggtcagtggttttctgatttcattaaatttactcacgatgttgaagtggatattgctaaattagatttcagccctaaattgtctcaagcagggttgttggtgatggatatggattctaccgctattcaaattgagtgtattgatgaaattgcgaaattagcgggtgttggcgaacttgtttctgcgattacggaaagtgcaatgaggggggaattagatttcgagcaaagtttgcgttgtcgagtgggtacattaaaaggtgcgccagaaagtatcttacagcaagttagagagaatttaccgctaatgtctggattagttgaaacgatccaaaccttacaaaaatatggctggaaaactgcaattgcttcaggcggatttacttattttgcggattatttgaaagccttattacagcttgattttgcggcatcaaatcaatttgatattgaagatggaaaactcactggcttagttaaaggcgatgtggttgatgcccaatacaaagctaaaacattacaacatttgttagaggaatacggtattgattcacgacattctattgctattggcgatggggcaaatgacttggcaatgatgaatgtggcagggctaggtgttgcgttccacgctaaacctaaagtgcaaccacaagcgcaaattgtggtaaacttcgccgacttaaccgcacttttatgccttttaagtgctaatgatcgaatttaataaaacgggagaagactatgccatcttttgatattgtttctgaaattactttacacgaagtccgtaatgcagtggaaaatgccaaccgtgtgcttagcacgcgttatgattttcgtggtgtcgaagcggtaattgaattaaatgaaaaaaatgaaacgattaaaattactacagaatctgatttccaacttgaacaattaattgagattttaattggatcttgcattaaacgtggtattgagcacagttctttagatattccagcagaaagcgaacaccacggtaaactttacagtaaagaaatcaaacttaaacagggtattgaaacagagatggcgaagaaaattactaaattagtaaaagattctaaaatcaaagttcaaactcaaattcagggcgaacaagtgcgtgtgacaggtaagtcacgcgatgatttacaggcagtcattcaacttgttaaaagtgctgaattaggccaaccattccaatttaataattttagagattagttttcaaataagggcgaaatgttgtcatagttttttgataaaacttgacgaacaccgctttcaagcgtaacattcgcccgawtttttaacgagaaggacacacactttggacagtcatagtcgataccgaatatcgctctagacgctcgccttttattatcggcgcgcgttcgccggtaaatttaccgttgtttcggcatctcttaacgaaaactttgcgatttttcaccgsactttcgtttcttctttaatttgttcactgttagctgttcataatcctataaggagtatgaaatgatcaacgcgtttgctatcaatgattcccgcttggttcgcattgacgaagaccaaactgatctcaatactgccatttggcttgatttacttgagccgacaggcgaagaacgtgaaatgctacaagaaggcttaggccagagcctagcatcttttctagaactggaagatatcgaggcttccgcccgtttctttgaagacgaagatggtttacaccttcactcatttttttattgcgaagatgaagacaattatgctgatttagcgagcgtcgcttttactattcgtgatggtcgtttatttacgttgcgtgatcgcgagctaccagcattccgtttatatcgtatgcgttcacgtagccagcgtttgttagaatgcaattcctatgaagttttactggatttatttgaaacgaaaattgagcaattagcggacgtgattgaaaatatctatgcagatttggaagagttaagtcgtgttattttaaacggaaaacaagatgaagcctttgatgaagcattaaatacactcacggaacaagaagatacgagctcaaaagttcgtttgtgcttgatggatactcaacgtgcattaggtttcttggttcgcaaaactcgcttaccaactaatcagttagaacaagcacgagaaatcttacgagatattgaatctttgcaaccgcataatgaatcattattccaaaaagtaaactttttaatgcaagctgcaatgggttacatcaatattgaacagaacaaaattatgaaattcttctcagttgtttctgtgatgttccttcctgcaacattagttgcatccacttatggtatgaactttgattttatgcctgagttacattttaaatatggctatccaatggcaattggattaatgatcgcagccgcattgacaccatatatttattttagaagaaaaggatggctatgatggaattatcccaaaccgcattatttatcggatcaattattaatcyttacgcacttgtattaatcttacgagcttggttgcagtttgctcgtgtggattattacaaccctgtttcaacatttgcagtcaaaatgactgatccagtattaaaacctctgcgtaaaattgcgcctactgtgaaaaatatcgatacttctgctttactgctaatatttattatcggtatgttaaaaggtattatttattttggcttatcagtaaatgtactcttagtattaggcgtattaactgtattgaaaagcattggtttagctattttctatgtgctttttattggggctgttttaagttggtttaatcgaggtaataattctataagttatgccttttatcaactctccgaaccacttttaaaaccaatccgtcgattattacctacattaggaatgattgatttttctccgatggtcgttatgtttatcttattgtttttaaacaattttatgcttgatcttctagggggactttggattatcgctggttagatattcatattccttatttgaatattgctttataaaaatattgaagatttagttggtaagaatagtattttctattcttacctttttatttcgtttttagaggtttttgatttttataantcttataaaagatataaaantcttttataaaaataaggggaagtttatttacattgacatttaaatagcagaatttattgtcctattacctaaagtaccatcatcaatcgcttcttttggcgtcccaataacttcggcgattttctctccatttttaaaaaacacaaatccaccattttccatttttgtccaagattcatttttggttaaaggaaatgttgtgatgatattgaccttatctcctgcttttgcataatagctaaaatcaattactccatcatcatcaatacggtgagctttgccaaaaggtgcttttcgcataacataatgtaagtttgttgagcaatgtgcaatcatccactcgccattagaaagaatgaaattaaacgtaccgtgttgagcaagtccttttgttactttttgaattgcttcaaaaatttccatttcacttggttttttgcggaaagtgtttttaagatattcagccatataacagaaagcagcttcagaatctgtagaacctattggctgtaaaaaatgatctgtcatatctggtaagttttttaaattaccattatgcgcaaaaacccagttttgtccccaaatttcacgaatgaacggatgggtgttttcaatattgacttcgccttgtgttgctttacgaatatgtgcaataacattaagagatttaatattatattgttttatacaatctgcgatgggggaaagactggctgcttgattatcacgaaaaatacgtacaccacgtccttcaaaaaacgcaattccaaagccatctgaatggcaatctgttaaacctgcacgacgacggaaaccttcaaaagraaaaacaatatccgttggcgtattgcaattcattccgagtaattgacacataactttaattagatataacctcacaatatgtgagtgatttaacaccattatagggagaatatcaagagagatttaatgaatttttatgttgtatagatattaatgatagaaatcttatttaatctattattctttaaaaatcgagatttaacagtctctttcggctgatgtattgtggtacaagcaaataaactcacaaggaaaacmacaagcaatgccatctttaatttattcataaatacnaaattccgagaaataagnaagcgcgtatgatagcggaaattggggattgtgcaagggattggaatgagactaaaaaaccgaaataaaaactggaaatgtaattccaaatacatcaagaaacaaataatatggaaatcaacttccaattttcgtatactttttaaaatatgaaattaacttccaatgagtaaagctatgatctctcgtgaaaattatttacaacaactgattcaatttaaagatactgattttatcaaagtcatctcgggtgttcgtcgttctggtaaatcggtgttactcatgcaataccgtgattatctgcagcaacagggcattgcttccgaaaatattctttacctcaattttgaatcttttgaatatcaatgggtgaaagacgctcaagacttccaacagcttattcaagaaaaaatgccgtcttctcaagagaaaatctactttctgattgatgaaattcagtttgtagaaggttggcaaaaaatcgtcaatgcgcttcgcgtgagttttaacactgatatcgtgattacaggttccaatgccaacttgctttccggtgagcttgcgacgctgttaagcggtcggtatgtagaaatcaaaatttacccgctttctttcaaagaatttttgcacgccaaaaatgtggatagccaatcaagattggtcgataaactctattcggaatatgaaaaatatggcggtttccccagtgttgtgatggctgatgagcctttaaaagaaacgattttatcgggtatttttgattccatcgtgctaaatgatattgcccaccgagctggagtgaaagacacgcatattcttaaaagtgtgattctctttttagcagataatgtcggtcagttggtgaatccaagcaaaattagcaacacgctcacgtccgaacgtgtccccacttcaaaccataccatcagcaaatatcttgatttgttagaaaatgcgtttcttttttataaagcaaaacaatacgatattcgcggaaaaggctatttaaaaaccaatgccaaatattttattgtggataacggtttaagacgacatgctatcggcaaaaaaggcgcgaattatgccaatcgactagaaaatatcgtttttattgaattactcagacggggttatagcgttgatgtgggcaaactcgacagcaaagaaattgattttatcgctcgaaaagccgatgagattttatatgtgcaagtcgcctttgaaatacctgaaaatacccacgaaacagataatcttttgcatattaaagataactataaaaagatcttaattacgggcaaatattacgaacaaacggagattgatgggattgaagtgatttatgtggtggattggttgctgcaataaatccaaaaacgttggaaattttaaccgcactttttgtgattaatgtttgtggaggcacgtgttttctaacgcgcaccaaagaaagtaaataaagtgcggtgagtttttgaagtgttttttagtgaaattaggtacacgctaggaagcgtgcaccaacagattgtgctaataaggraagatagcgccagcgtcctcactggtgctgtttaataaaacattgcgaattttacccgtaagccactggcagaaccaatattcaaaattctttggattttttgaccgcacttttagttgataggcacaagagaggacgcttgtgccattatggagaaacttcatataaagttatactatgctatactacgtccctcgcagggagaaaagctatatgaatataaaacctcatttatttgggcttaatcgctcaaatcgtgatttttcattaagagaaacttggggaaaaaatcaatttaattcttcatttccagtttctttatgttgctatatgtcatcaaaaggcatacttgctaactacttgtctatagaaaatgcagagataaagtgcagttctatcgatataaaagatgtttttgaaattgaacctgagaatgaaaatacattttttgcatttgaaacatctcattcaattaaacttacagcattaccggatcatacaacttgcgatctaactgatgcagattttggtagtgaaatagtcattcgtccagatagtattgtttatttagcttgtagtcttgctgagattttaaaggaaagtcttgctaattgtatggatattccgaataacgtagatcacttagattggtcagaaccaaaacaagttataccattatttcctcatatactatcaacattaaacaacctttgctctagagcagatactattcagactccctttttgttacagcctgtgtggaaaactttaggtaaatctcctagattggctgataactgtctagatatttttatatggagcgatgtagcatttgtcaaatttattttagaaatatcgaatttaaatgtaaatgttttatcaattaatcgacaaactagaacggctatttggctatataaaatgttagttgatatagtgaagtatgggcgttttaatcaccataaaattattgatttgtgttcttataatacaaagaatgataaagcttttgcttcctctggaatgatcacaaatgtctttatgaaaagtgaacgattagaacgtcctataataatgaagtctgaaataaagaatattatcttaggtggaggacaagaattacttagtccagaacgacgttttgatgcaattatttacaattcttcggagttatttagatgaagtgtgtagacttattttcaggatgtggaggtttatctcttggttttgaattagctggatttgagatctgtgcagcttttgaaaattgggagaaagctattgagatttataaaaataacttttcacaccctatatataatattgatttgagaaatgagaaggaagcagtcgaaaagattaaaaaatacagtccggatttaataatgggaggtcctccatgtcaagatttttcaagtgcggggaagcgagatatatctttgggaagagcagatttaacatatagttttgcaaatatagtgtgtaacattcgtccaaaatggtttgtaatggagaatgtagaacaaattaaaaaaagtcatatattgcaagatattattaatcaatttattgattttggttatgggttgacttcagctatattagatgcctcttactgtggtgttccacaatctagaacaagattttccttaattggaaaattaaatagtgaacataattttctgattccaacattgtctagaaaattatcagataagcctatgacagttagagattatttgggaaattcattaaatctagagttttattatcgccatccaagaaattataatagarggggaattttttcaatcgatgagccaagtccaacgattagaggtgtaaatagacccattcctaaaggatataatataaacagttgtgatcctaaaggagttgagttagcaaaagttagaccattaacaacaattgaacgcagttatattcaaacatttcctaagtcgtttttattttcgggaacaaaaactgatttagagcaaatgataggtaatgcggtaccagtaaatttagctaaatttgtagctagtgcaattataaactttgaaaaagaaccaataagatctatgggataaattgatttatttgaaaataaagtatctccttttattttatcagagaaagtgctgcataagataaaagaacagtatatatatcaatgatcttttatattaaagaccccaaattatttacccaatttggggtctttattttacatttctacttcatcgctacacccaaccatttcatcatctctctctcatcccaacctttacgtttggcataatcttgagcttggtcttcatcaatgcgaccaagtgtgaaatagttgctagcggggtgagtgaagtaccagccgcagacagaagcggcaggccacatggcgtagctttcagtgagtttcatgccgatgcgttgttcgacttctaataaatcccaaattaaggctttttccgtgtgttccggccagcttggataacccggtgcagggcggatgccgacatagttttcgttgattaaaccttgattgtcaaattcttcttgcgtgtagccccaaatgcgggtgcgaagctcaaagtgcaggtattctgccatggcttcagcgaggcgatcgcccacagcttgtagcaagatggcgttgtagtcatcgcctgcggctttgtagccttccactagctccatttcttcaacgccgacacacacggcaaacatgccgaaccagttttttttgccactttggcgatcggcgataaagtcgcttaagcagaagttaaatgggcttttgctgtttttgccacgttccgtttgttggcgtaagccgtaagcggtgccaatggtttgtgtgcgttcttcatcagagaatagcaccacatcatcgcccacgcgttccgcagggaaaatgcctaaaatgccgcttgggttgagtttgtggttttgttctaattcatctaaaaccacttgtgcatcgttccacactttgcgtgcttcttcgccaccttcaggataatcaaaggcatccggatagcagcccatcaagccccaaatacggaagaatggcgaccagtcgataaatttacgcagttcggcaatcggtacgtttttaaattccacaatgcccgtttgttttggcgttggtggcacgtaatctgcccattcaccactaaagccatcacgtgcttcttcaatgctaagctgtttacgtagcggtttactatttgcaaaagattgttggattttctcgtaatcctttttgaactgttcccacaatgctgcacgcccttcagggttcattaaggtggcacatactgttaccgcacgggaagcgttagaggtatagaacacacagtgttgtttgtattttggataaagtttaatggcggtatgttctttggaggtggttgcaccgccaatcatcacaggcaggtttaagcctaaacgagtcatttcacccaagaagtattccatctcatctagagaaggggtaattaaaccacttaacgcgatgatgtccgttttttgattaatagcggtttgaataattttgtccgctggcaccatgacgcctaagtcgatcacttcaaagttattacattgcatcaccacactcacgatgtttttaccgatgtcgtgcacgtcgccttttacggttgcaatcaccactttaccgttgcttgaacctttttgtttggttgcattataaatggttctaaatacgccacagattgtttcatcacgcgtgcggattttaccacttgcggcaggaacattttaccatcgccgaataaatcgccgactacgtccatgccagccatcaacgggccttcaatcacatctaatgggcttggtaatgtttggcaagtggtaatccctttcacaagggcgtgttttaaaagttctcccactggccaagtgcaccattctgcgacagaatcgaccgcacttttcttaaacttctcacctctaaaatcgtcttctgtcagtttatatttttggatcatcgtccccatcgcaccgtctaaaatgagaatacgattttctagagcttgtttaagttgagcggttttattcaccataattattttgttctgtaaatcttaaataaataactacggaataataggtgtaagggctaggggtgtcaaatgttagaaggaaagtgcggtggaaaattaaggttttttatttaagtgtaatggctgcgacaaaacaggtaattttacattctccgcacccattgcaacgttcattatcaatctctaaagtgctggagattgcttgtagtgggcaagcggtttggcagtctggacaggtttgattttgtaggattaaacaggctgaggaaaattgtggacgaagtaatgtatctcctggaaaattaggatgtagtgcatttntcggacaaacttctgcgcatttaccacacaaatcacaaggtgcgtagtcaatttcaagggtggcttgttgctgttttagttgaattaaaccattaggacaagctgaagcgcattccccacaaccattgcagacggcggaaaataaatcttctcgtgctgaaaagggaggacgagactgcgttttttctattgttgattttgtagctggaaatacatgacgcaatagtcctctacgagaaatgtgatggtggcttaaataagcctgataataggcttcgtttttcattatcgataaaatcttactgtcggtacattaatatgtaaatctacttgccattgttgtaaagtttttatggtaagtaatgcaagagcttgataaaaatcagaattttctattttgcttagttgttcaaggaaatgatacgcccaagttaagaagtgttcacgtagaaatttggttaataagtgcggtcgattttctgctaaatatgcagcaagcattagcattaagccaatatgatcttctggttcatcttgttgtgtttgaaatgcgatttgatgttgttgtaagaaatcgcgtaatgctaagagagaattaccaaaaataacacattcaggatcaagatatacggatccccaaggtggcgtaggtaattcatttggaccaataaataaatactgatattgttcagtgatattttgttgcagccctttttcaataagtgcggtgatttttttatgtgtttttacatcaaatgaaatttcccattcttgcatccaatttggttggcgaaagaatgtcaaaatatcagtaagtcgtgcatcattaggctcatagtaaaatactgcaccgagtaaacgcccataaatagaaatttgttgaagagtattttgcatagtatctccgaaaacaatttgtcattagtgaatggggatatgaggggtagttaaatattactaattaacgtttctaaaaattgaggcgtatgctatacgcctcaacataatttaaccaccaatcgtcataccgtaagtcatatgtaatccataaaataatacgcgaccgatgccttcagctactaacgttaatagaacggaaatacctaatagtcctatgtttttcactcggaataagaggaaagctacaatggaaagtaaacataagcgagttacggtcattatggcataatttggtacgaggtcagcggcattttgaatagcactgtgaatattgtgtaaattgaagccttgatatatggctactattgcgaccaatgataccccaatggcgaataaacttggcagatgctgaagctgatattcacgttgtttattagggattaataacgcatagctcaatgttaatccacctaatacaacggtaaggtagaatgaccaagaggttaatgcattattccaagttggtatgcttgtaatatggtaaacctgattcattacatacataaatagtatgccgataagggcggtcacaattcgccatacatttccaagtgaaactggcattttacctaaaattgcaatcagccagtagaaacctgctaatgtgaaaaatattgcaccagcggcaatttcattactcatcattgatgagccgactcgattaagtgaattaaatgcacgtataggtaagccaagatgcataatggaagcaataaatccaatacctagtaaagccaaaatcacaaacattactttatgaatataagtgcgactttttgtatttttctcatttaatagtacaaatgtgaaaacaagccaagcaccgaccgcactttgtgccaaaactgtaaaaaatactaatggcagttcatataatcctgtattcatcttacacctctcttgggtttcctaagaacccacttgtatcgccacttaaacgagcgtatttattgggttttaccactaaatttggttgagtgatatcagtcggtggtagtggtgcgatggaggcttgtgtgccatattttgttcgaagttcatcaataggagcgaaatccaatgctcgtagtgggcaggcatcaacacaaatcggtttttgacctgattttacgcgagaataacatccatcacattttgtcatatgacctttttgtgcatcatattgcggtgcatcataaggacacgccatatgacaataacgacaaccgatacaaatttcttcattgacgatcacgaaaccatctgcatttttgtgcattgcaccagttgggcaaacttttgtacaagcaggatctgcacaatgattacaagaaatagacatataataggcaaatatattttgatgccagcatccatctgcttgttgattccactgaccacctgtatattcataaatacgacgaaaattgacttctgtgccaagatctttgtaatccttacaggctaattcacaagttttacagcctgtgcaacgttcagaatcaaaataaaaaccatattgttccataattctccccctacaaacgttccacttgaactaaattagaatgttgcggattacctttcgcaagcggtgatgggcgttgtgtcgtaagtacattaatgcaacctgaatgatcgatacgatctttatctggtgcataccaagccccctcgcttaatgccacaacccctggaataatacggggtgtaatttttacattaatatgtacttcgcctcgatcattaaagatacgaatcatatcgccatttttaatattacgaggttctgcatcaataggattcatccaaacttcttgtggattagctgcttttaatacatccacattgccataagttgaatgggttctcgctttatagtgaaaaccacttagttgtaacggatatttttccattaatggatcaccgtaatgctcaaaactttgggcgtgaataggtaagggatgaattacgtcatcttctgctaatttccaagtttttgctatttcagctagacgagaagaataaatttcaattttgccagatggcgttttaagtggatgggcttctggattatcacggaaatctttgtatgcaactttaaagccattaggatcaacttttttaaaaataccttgttgtctaaattcttcaaaagtaggtaattcaggtaatttttctcgagattgctcataaatatggcgtaaccattcttcttgtgttcgtccttcagtaaatttttcctttacgcccattttctcagccaaatcactcaacatatcgtaaataggtctacattcaaaagatggtttaatcacttgatctgcaaaaatgacatatgccatattggatacaaaggcatctaaagcgaaatccatttgttctgaagttgtacaatctggtaataaaatatcactgtatttggcagtagatgtcatatgattatcaatagtaatgatcatttcacattgcgtatcatcttgtaaaatatcgtgagtacgattgatttgtgcgtgttgattaatcaaacagttacttgcgtaattccaaattactttaattggggacgataatttatcaacaccacgaataccatctgtaagtgcggtcatttctgtgccacgaataattgcatctgtccataaaaacattggaatgcttgctttcacaggattttttagcgttggcatccgtacaaatggaatgctatacgcactttcacgtgcaccagtgttaccgccgtgaattccaacattacctgttaagattggcaacatcgcaatggcacgagagattaattctccattactacgacgttgaggcccccaaccttgggaaataaaggcaggttttgtactaccaatttcacgtgcgagtttaataattctctccgccggaatacccgtgattttagccgcccattctggggttttagcgataccatcattaccataacctaaaatataggctttataatgaccatttttaggggcatccgtaggtaatgttttttcatcataaccaacacaatatttatctaagaaaggttgatccacgagattttcttgaatcattacataagcaagggcagcaacaagggctgcatcagtacctggacgaattgggatccactcatcttcacgccctgcaccagtatcattataacgaggatcgataataatcattttggcattggaacgagctttggcttgttcaatacaataagttaaaccacctccactcatacgagtttctgcaggattattaccgaataacactattaatttggtgttttcaatgtcagccattccatttcccaatgcccaaccaccaccataggtataatctaaaccgacagcaatttgtgcggtgctgtaatcaccataatggtttaaatatccaccaatacaattcataaaacgagcgatcatagtggatgcaggtggccaagatttagccattgtgccaccgagtgttcccgtaccatagtttaaataaattgattcattgccatatttttttatattgcgtttcaatgcgtctgcaatttcagttaaagcctcatcccaactgattcgtttgaatttgccttctccgcgtttacctatacgtttcattggatattttaaacggtctgggttatatactcgacgacgcatagaacgtccacgtagacaagcacgaacctgatgatcaagattatatgtttctgtccccgtattatcggtttccacataagtgattcggttatcttttacgtgcattcgtaatggacaacggctaccacagtttactgtacaagcactccaaacaatacgttcttgattattttcattgaggcgttgtgtctctttagccattacattgaaaggtaaagtaagatttgaaactgccagtgcagctcccgcagatgacgccttgacaaaatctcggcgacttatttgattaaagttactcattatatcgttcccccacagtcagattgraaaataactaaaacgagttaattataatctttgtatagaagttttacttgagccaaatcaattaatcattaataggtatattatttatagggtattttagtagattgatgttttaataaactttggaataacaaattgactatggatttaaaaatccgttagcatagtggcgtgttagtttatctaatatgttaagtttaactattattaactagaggatcttttcatgaagaaacttatcgcagttgcggtgctttctgcatgtggctcgttagctcatgcaaacactaatattccaaactacaatacagacgcccatctttacgaattcacgcaaacctatgatttagttgtgccaaaaggctcgcaaggacaaaccaatttatgggttccattaccatttaatggggaataccaacaagtgaaatcgattcactttgaaggtaattacatgaatgcctatgtaacagaaaacaataaatacggagcgaaaaccttatttgccacttggaataaagatgcacaaaagcgtgatttaaaagtcatgatggtcattgaaacaaaagaccgtgaaccgatggtgaaaggtgctttagagaattatactccgccaaaagatattcagtattccgtggatgtacaagaatacttaaaagctactccacatattaaaactgatggcattgtgaaagawtttgctgacaaaatcctaggtaaagaaactaatccattgaaaaaagcagaacttattcaccactggttcgtaaaaaatatggaacgtgataatyctgtattaggttgtggtgacggcgatgtagaaaaaattcttaccactggcgtgttaaaaggtaaatgtaccgatattaactctgtatttgtggcacttgctcgtgctgcaggcatccctgctcgtgaaatttttggtattcgcttaggtgcggcagagaaaatgggcaaatattcaaaaggtgccttcggtagtgcaaatgaacaaggcatcgcaaacgtaagtggtggccaacactgccgcgctgaattctaccttgcagggtttggatgggtaccagttgattccgcagacgttgccaaaatgcgtttagcagagaaaaaatctgttgaagataaagatacacaagccgtagcaaaatatttgtttggtaactgggaagcaaactgggtgggatttaatcatgcccgtgactttgatttatatccacaaccagaactggctccaatcaataacttcggctatccatatgcagaagtaggtggcgatccgttaaattcctttgatccaaaagaatttaaatatgactacgtctctaaaaaactctaataaatccttttgggttgccatagcgccgactaagtgctgcggtggcatcaaccttgtgctgcatcgcaccattaatttatttagtatttggtgtgtcgtccacttggttgattggcttaggcgaatatgattatttgcgtattcccatgcttattatttcattatgcgcctttgcctatggattttggctgttgatgttttccaaaaaaatcatttgtagcaaatatatttcccgtaaaaaactcatcgttttatattggattgtatttattgtgatgatttttttcttaacctatccaacaattttgccttggattttagaattagctaattaggaataaaaatgaagaaattatgtaccgcacttttgctttcgctgtttgcaatctctttcgctcatgcgaatgaaaccaaacaaattgtgctaaaagtaaaggaaatgaattgtcagctttgtgcttacttagtcaataaagaactgcgtaatatcaatggcgttatttcaacaaaagcatctattaaagatggtttagtgacggttgtggaagatccaaatgtcacaaaccaacaattattcgatgcaattcacaagctgaaatatactgctgaagtcgtgaattaaacgctaaatatctagcaaaaaagtgcggtaaaaattcaccgcacttttctttagctattaaattagactaattttttaattagtttgattacagtacaattaattaaatatgataaatgcaatattattcagcactttcgcttaaaaatccgccactttgatgattccaaagtttagcgtacagaccattgagctctagtaattcggcgtgcgtaccttgttcgacaatttgtcctttatcaagcacaatcaggcgatccatcgctgcgatggtggataaacgatgggcaatggcaatcacagttttattttccatcatcttatctagactttcttgtattgccacttccacttctgaatccaatgcacttgtggcttcatctaacaatagaattggtgcgtcttttaacattacacgagcaatggcaattctctgacgctgaccaccagaaagttttacccctcgttctcccacatgggcatcatagccttttctaccttgagaatcactgagaaatgggatgaaatcagcggcttccgctcgttcagcagctaaaaccatttcttcatcagtagcattcgggcgaccataaataatattgtcacgtacagaacgatgtagcaaggaagtgtcttgagtgactaaaccgatttggcgacgtaagctttcttgttgcacattgagtacattttgtccatcaatggtaatttcgccttgttgtgcttcataaaagcgaagcaataagttcacaatcgtagattttcctgcaccagaacgaccgattaacccaaccttttcccctggtttgatagtgagattgaaatgattgagtaatggttttgtcggatcgtaagcaaaggtaatatcgttaaacttaatttccccttgtttcacttgtaacggtgacgcttgtggtttatccacaatagtgtgaggtttggttaaagtattcattccgtcgtttacggttccgatattctcaaacaaacgggcagattcccacataatccagcgagaaagcccatttacgcgtaatgccattgccgttgccgttgctattgcacccacgccaacttgaccatttttccataaaataataccaagtattgcagtacttaacgtaagtagaatatttgtagcgtaagtgagtgtatctagtgatgttgctaagcgcatttgggcgtgtactgttaccataaaatcttgcatagaacgcttggcataagtagcttcgcgtgagccgtgagaaaataattttactgtagcaatattagaataagcatctgtaatgcgtcctgtcattaaagaacgagcatcagcttgtcgttgtgcggtttttgatagtttaggaattagggttcgtaggatcaaaccgaagagtataatccaagtaataaatggtaataagaaccaagaatctaatgccactagcactacgccagaggtaataaaatataccaatacataaacgaacatatttgcaagtgtaagtactgtgtcacgtactgcaagggcggtttgcattacttttgcggatactctacctgcaaattcgtcttgataaaaacttaaactttgtccaagcattaaacgatggaaattccaacgtaatcgcattggaaatacgccttgtaaggtttgtaaatgcacggccgaagctaaaaatccccacacaatactaataagtaatagagcagccattccaattaataaatgacttttttcttgccataatctttcaggtgtaaatgtgcctaaccaatctacaagcgttcccataaattggaataatacagcttccattacacctgtacctacggttaaaattgcgagcaaaaaaatccagcctttcattcctgtaatactagaccaaataaaacggracaaaccttttttaggtgttgttggattgctttctggatagggatttaaacgattttcaaaccacgaaaaaattttgttaaacatatcttttccttaaaaagaaaggcaacgcaggttgccttttagaagtgcatattattatagcacaaaaacaaatcaatttataggctgacagattttctgtattggcttggagaaagttggtagtaatttttaaaaactttacaaaaatgagcttctgattgataccccacttctaaagcaatggcaagcacagattgttgtgattgttttaataaaaacgccgcagattgtaaccgcactttcgtgagaaaacgtcctggcgacataccaatatgttgttgaaagatacgaataaagtttgcacgagacattgttgcaagttcagctaattgttcaatatgccaatcattttgaggttgttgtaatattgcgatcagtgcagtatttaatcgcttatcttgcaaggcaaataagatgccttgttcaattaaattttgttgaatagcgtggcgtaaaatataaattaaaagtacatttgaaagtgcatcaacgacggatttcgtacccgcatcatttttttgcgcttcttgtaaaaaaagctgtactaaaggatgaattggtgtgtcgcataaatttatatgtaaatattcaggcattgatgctgtaagaagcgcatcttgttgataataaaaattaccgcagaacatttttaaatctggtgtacctcgtccaatctgatgtaactcaaataatccttgatgacttttttttgtaggaatatccgctcttttatttgctgaataatgcatagagtgcggttgattttgaggaagaaaaaaaacatccccctcttttaaatgaaattgtttttcatttagtgtaagccagcactcgccttgttcaataagatggaatatgcctttycctgcatccttttcttgatgagatatttgccattcgccttgaaattcacagcgaatattaatttctccacgcacttgtgctaaatgggtaagtttatctaaatagtccataatgagatgttagcgataaaaattgagataaataagcaagtatcataatctaatccgcctataatttgccacaccagttggttattaattcaatatatttaggagaacattatgtttacagattggaaagaacacacatctcacgttaaaaaatcatttggtgaattgggtaaacaataccctaaaatgttacaagcttaccaagcattaggcgcggcagctgcagagggcaatgtgcttgacgctaaaactcgtgaacttatcgcattagccgttgctgtaacaacgcgttgtgaaagctgtattagtgcacacgcagaagaagcggtaaaagctggcgcaagcgaagctgaagttgctgctgcattagcaacagctatcgcattaaatgcaggtgcagcttatacttattctttacgtgcattagaagcatatagcgtacagaaagcttaattactcatcattccataaagttaagttgattaagagaaagggagcatttttttaatgctcccttgttttgttaaggttgtgttttaataatacaccactctatttttcaagcgatgcctcccctaaagggaatgacttcgtaaattgttcatattcttttggatttttctcattgtcagtaaaaaacggcaaaccgatcaaacgataatgcggtgtatctttttgcagaatcttatccttgccatattctgctgtgatggcttctaaaaattcttttttccacatatccgtctccactaaatgctcacctttgggttcaatgaaaatttggtaatgcaaaaagtcgtttacaccattggaagaagatttttgtttgtctttcagcaataaaataaagtccggcataaatccttcaccatcagcaaagttattcaatttaaacacttcttcattacggattaaatgaacatcatatttagacttcaaatcgcccaaacgctctgaaataaattgaattaacgcttcttccaaactcgttccagsaaaattatccatcacataccaatcattttgcgtggcaatggcagtttttacatcatcttttttgacccatttttgttttggtgtgccaaaaatttcccataattttttaggcgtaaattcttttgtaccgataaacggtatatcactttcattgagatgtttttcaaccatttccaagattttcaggcagcctgcaagtttgtcatctgggctaatctgtttatcttgccccaatcccaaaaattcaatttgccaatcttttaacaagttattttgcaattcattgcgattttgaatgttgagtttgctttgtaagcggtcaaaatggaataaagattgactattttttcctttgatatgcaaggctttattaaaaatgtgccgctctatttcactcatttctatggtttcagtaaaattattttgtgtgccgatttgtcgggctttttcatcattttcatcggctgtaaattgcgtttcttgcaacaatttgccgtgaactgggaatggaagcggttgcggtggcggattggcttttaggctgtctgcattattggctttggcattgggattagggatttttttattcgcccaaatcaataagtttttaaaattttcattatctgcaaattcagattttagtttgaatgtggttaaaactttatctttatcgttttcgggaataaagccatctttgcgaagttctgcttttaattctgaaatatagcgagattgctcatcgtgcgtgtaataaaacaattcttccaaaatacgcaattcgtgttgcatatcgttgtcaaatttgcgtttattcggctgtttatcttcaaacgcaaatggaaaataacgcacgccacgaccaattaactgcttttctgatacggtggcggcagcttttgcccgattttttatttgaaccgccgccgttttgcccttcatacaaacgcacaatatcaaacaaattcagaacgtcccaaccttcagttaatctgtccaccgtaaaaatagcacggntcggattatcagccgcttccaaattatttagcaattttnccgtttcactgtcggttttttctgttttgcttttgttggtttcggagttggtgataatgacattgtgtttttgataattttgttttacccaatctgccaaatgcacaaactcaaatttattgtcctgtataaattttagggcttgttcggtacgggttttgccttgttcgttggcgttatcgctatcgtttaagcttgccaaaaatgtcgttaaaaacgaaaaatcaaccgcttgcacattttctacccaatttaaaaatgccaaataatccgcctttgattcatcaatcgtcttacttctaaacaacatcacaggcttgaaattggcaatgccatatttcaatgcaatttgatggcgataccaagcaaacaataaagcgtgcaatactcgctctttcttgcccagcgtactggataccaaattgatttctttggtataacctttttgcaaaaattcttttaaaccaaattttgtgatgattttatcagcatatttttgttgcacttcagcattttcaggcagtgtggcggtaaattccaacagcacattttcgctgggattgccatttttattgagtaacaattccaaaaccatatgctcccagcctttgcgttcaatttcggctttgctggtgcggtcgttcatttccttttctaaatctaattcgccttgttttttgcctttggtttgcgcgtttaaatggtgtgcttcatcgcccagcatcacaaggttcaaatcgtgcagatccgtcaatgtggtttgattttcctgttcggtgtgaatatcgttatacagtttttgaatgctggtaaatttaatttcaatgccgtctgaatgtgggctaaacgtttccactttgcgaatgggaattaccgtatcgccctgcaaaatcttctcggtaaataaaaattttgcgtgcgtcggatcggtaaaattattttccgttttatccacgatattgttttgattcacaaaaaacagaaaatgccgataccctttttcaaaataatacaaaatcaatgccgccatcatcatcgttttgcctgcacctgttgccatattgaacagcaaatgggtagggcggtttttgatgtcagggaaatcctttaattttgaagtgcggtcaaaaatcaaaaagttttctaatgcggacttttgccattcaaaaaatggatattttaaattgcgttctacaaattcaggcagtgcgaaaaaatccgtctgctccatttcttctagggttgatttgcggtcttccacccaatcaaacaaagttttatcattcgccatcttttttctccgcttgatagaacgcacggcttaacgctttatcgtcatcatttaagcatcctgcaaattgttcatcgtccatttcggataatgaaacatacatttgatttaaatccaacatttcaagcaccatttgtttttgttcgtctaatggcaaagattgaaattcaggctcttcaataatttgactaaattctttcacgctgacgttgtattttaggaaatagcgttcgcataaatcttcaaacagcgttttgatgtcgtctgaatcttcgcacgccaaaatttgttgttttgcggtttcgttaaatggagcaagttctgcataaacaaactcgccaccaccttgccaattcacggctttggatataccgccttgctcgccatcaatcacttttttcaagcgttcaacggcaagcgtttcaatataatccatttgttcaatgccgatatattggcggttcattttgtgagcaacggcagcggttgtaccactgccaagatggtagtctaggacgatgtcgccctcttttgttgtcatatcaattattcggcgtaataaggcttctggtttttttccatttttaaaatcaatatatcccccctctttatttagattgttatattgaatatcgtcccatagtgtattaaccttttgtaagtaaaaatatttatttttttctttgattagcatatcagataggnacataaacatatctttatttgaagcattgtaaaaaacttctataagattacctgcgtttttacccttttgtggaatatactcaatgctaacaataccattttttatggaatataaatcttcaattatcttgcttctgatgctagattgagcatttgtagttctataaactttatgtgaatactccgtataaattatttcttttgataaattttgatcttgtgaaaatttaacaattgaagtcatctgtgcgttaggataatgataatatttgaagccatccttttcttctaaaagtattttctcacctaaatcaataagaacctgcgtatatttccaactttttccactatcttcatagtttttaataaactcattaacttctgttttctgataaactgggttaagaaataatctttctctattttttgaaaaaacattaataaattcagtagaatcttttaaacttttaccttctgaacttcctgatacaccaccaattttggttttaacagtaacaatattcaaaaaattatctctatcaaaaatatcatccatcaatattttcaaataagcttgttcaatgtcatcacattgaacaaaaatcacgccatcatcagctaacaatgttttcgcaatttccagccgatttttcataaaagtcagccaagtggaatgattaaatttatcgttgtatttgaaaccgtcattgcccgtgttatacggcgggtcaatataaatcagcttaactttacctttaaactgcttggcaagcgaatgcagggctattagattattgcctttgataatgagattttcagcaggcgtgccgtcagaatggcgttttatttcgccaacggcttgtttgccgtctgcggtatagcgagagaattttgagaatgcttttgcgtcaaaaagccggtcaatttcatcaaaagcaagcgtttgattaaaaaagatttcttgtctttttcgggttaatttggtgtataattgactgactgactgactgactgactgactgactgactgactgactgactgactgactgactgactgactgactgactgactgactgactgactgactgactgactgactgactgactgactgactgactattattgcgtttaaaataaatttcttcgccttcttcggtgctttgcccgccattcaatacacaatctttaaacggaaaatccaacacaatatccgaactgtctttcaaaaagcggttgccgtccgtcaagccaatgcgattggcgtattttgtgtaggaattattgatgctgtgtttgtccaagaaaaaacgaaaatcctgcaatttaaacaccaaaacaccattcacttccacaaagaaatggcgttttaaatcatcattccccaataacaaaccgatgatggtcgggtcggttttttccaccaaatccaacagaatgtttttggctaaaatggttttttcttcgttcgcccatactttttcgtgtgatagtagggcttgggttaattcggtttgaatgtctgtcttcatcgttatcaatcctcataagtcattattttaatgtgctattacaaaggaatagcagagtgtttaggtatatttatcgaccgcacaggtttaattactctcttaaccagttttctttgactcacagaagtcaaaaaattttgtttatgtgcatcaaattttagtgaaagcattaacacagtattaaaacacagcctttgttaaaccaaattagcattctaaaactgttctagtgctttttttactggggcaaagctacgacgatgttgcggtaacgcgccaagttcagctaatttttccaaatgtaatttggttggatagcctttatgctgggcaaaagcgtattctggatattgcttgtctaattcttccatttcttggtctcgtgcaactttcgctaaaatagaggctgcactgatttcagccacaaggctatcgccttttaccacggcttgcgctggaatagctaaatcttttgggatcttattgccatcaatcaacacaaagtgcggttgaatttttaaagattttactgctcgagtcattgccagcaaggaggcttgcaggatatttatctcgtcaatttcgtcagcttcagctcgacctaatgcccaagcacgggctttttctttgatttcttcagcaagggctaaacgttttttttctgaaagttttttagaatcagctaatccttcaattggattatgaggatctaaaatcacggctgccgtgacaaccgccccaactagagggcctcgcccaacttcatcaacgccagcgatcaatttatagccttgtggatattcaaacattttcttttccttctaataaatcaatgaccgcttgagccgcttgcttatcggcattgcattgaattttttggtgtaaatccgtgaagtgctgaattaaaacatggcgattttttaccgcactttcatcatcagaaagataaactgatagtttttcagcaagcaattctggcgtgcattcttcttgaatcatttcaggaacaagcatttcattcgcaagcaagtttggtaaagaaatataatcagttttcactaaacgttttgctaagaaataggtcagtggtttcattcgatagccaactaccatgggggatttacaaagcattgcttcaagtgctgctgttcctgaagcaagaagtgttgcatcagctgcgatcattgcttgtcgtgcattgccatcaattaaatgcaggtctagatttggcgtaattttagctttaatggtttcaaattgaattcgtcgtttttcgttcactaaaggcacgaggaattgtaaatctgggaattgttcttttaataataaagcggtttttaagaaaggctcagccagaaattccacttctgaacctcggcttccaactaagattgctaaatagcgttgtgcgggatcaatctgtaacgtttggcaggcttcggcacggtttggtttgagcggaatagcatctgccattgtgtgcccaataaaacggcaaggcacattaaatttatcgtaaaaggctttctcaaaaggcaaaaaggctagaacttgatgagttgctttggcaattttatggatgcggttttgacgccaagcccatacagaggggctcacgtaatgaatagttttaattccgttcgcttttagtttaagttctacatccaaattaaaatcaggcgcatcaatgccgatgtaaacatcaggtttttcttgcaacatagtttgaatgacatttttgcgaattttcaacagacgaggaagatgttttaatatttcagccaagcccatgactgaaagctcttccatatcaacaagcgtctcacaaccttcagccaacattcttgggcctgcaatgccaataaagcgcgcattaggataatgtgctttgagctggcgtattaatcccgccccgagaatatcgccagacacttctcctgcaacaagagcaatggttggatttgttttgttcatcaaatttatcctaaaaaataaccgcactttggtgtgtaaagtgcggttgaaaatgaagaagttttattaacgaataatcccgcgagttgaacgtttgaaaaattcaacaaaaaaactgatcgctgaatcggtttccgcaatttgctcaatttctggtaacacttcttcaagtgttttaccgctacggtagagcattttataaatgttacggattacgtgcatagttggtttatcaaaaccacgacgtttcaaaccctctaagtttacgccaaatggacgggcgtggttaccttgcgccataacataaggtggtacatcttggcttaccatagaaccaccgcctaacataacgtgtgcgccaacaatcacaaattgatgaattgctgacataccgccaacaatcacgaaatcatctaattctacgtgacctgcaagcgttgcattgtttgccagaatacagttatttttaatttggcaatcgtgcgcaacgtgaacattaatcattaataaattgttattgccaatagcggttacgccacagccttgaatcgtgccacgatggattgtcacgtgttcacgaattttattgctattaccaataatggtttttgtagcttcgcctttgtatttcaaatcttggtttacttcgccaatactagtgaattgataaatttcgttatcttcgccaatcacggtatcgccacgtaccacaacgtgagatttcaatacagtgcgagctttgatttcaacagtaccctcaataatacagaaaggcccaataaaaacatcttcgccaattaccgcaccttcttcaatgagggcagttggatgaatttttgcacttgggtggatcatatttaccccttaattaacgacgagcacacattagttttgcttcacaagcgatttcgccgtttacggtggcaacgccagtaaatgcagtaataccacggcgttttttaatcacttgaacgtttaattccatttgatctcccggtaatactgggcgtttaaagcgcgcttcatcaatacctgcaaagtagaatagttcgccgccttttaattcgtgagttttaaaggctaaaatgcccattgcttgtgccaaagcttctaaaattaaaacgcccggtaaaatgggttcgcctgggaagtggcctgtgaaacaaggctcattgacgctgatatttttaatcgcttttaaccattcgccttctttaaaatccaatacgcgatccactaataaaaatggatagcgatgtggtaataaagtcataatttcttttgattcgatcacttttggttgttgttctgacacgttgataccttacaaaaaataaacaaataaaatctatcggattatacgatatttatagctaaaaataaaacgcactcaatatagcctagtgtttaggacgaatatcaatggctggatcgtcatctttacgatatttttcatcaattcgtttttgcaatccaaagtcatttttatccgactcgttagaaaataaatcttctgtttgcgttaattgaggatttttaattcctatccaatttgcgattccttctaagaagttcaaacctgatttaaacaccttatattctttgcgttccatatcatctgatgaaattttgaatagcggaatattatggtgctctcggctgaaacagttttgattgaacaaaagtatattgttttttcatcttgttggtggcacaaaccgtgatctgagaaataaatcattgaaaaagtgcggtgatttttcttcacgttttcttcaagctgatcatatacacgttttaaaaattcatcagttttcttaatagatgaaacatagcaatttaaataaccatatctcggattaagatctttatcatcaaagatttttggataatcttcgatacgatcgcaagccattgggtgtgaaccataaatatgcaacacaataaaacgttttccttgaacagaattttctaatacttgggcgaatttgggtaataaatcaaagtcactaaagttagtcgaattaaagcttccgccttttttcaagaaaaaggtttcatcagattttgatgcaagggatgaaactggcgtatcgaatttaccgatcatcccatgattagaaagccaataagttttaatgcccgcagatttgatgagatctactaaactcaaactgtaattgggttcccatttttctttgtctggaaaggttagcattaaacgaagtgaggcgacggtatttgttcctgctgaacgaaaaccatcaatcaacgtgcctttagcgttagacataaagggggtgttttcaattggataaccgtaggcatggtggtaatctttccgtgcactttctccgagtacaattacataatcatcatagcgtgaattttctaatgttgattttccccagttatcagattgagagatttgttttagtttttgcacttcatctacaatttttaatgtggaacttactgtttctttgagcggttcagcaagcggcatgttgtaagcaaaaagcaatgtcgccaaggcaataaatgttttattacgataaaattttatgccaaatttcaccgcacttttgtactgaagaaaaatcaaaataggaatggcgaaagcaattaagtaactactcactgggatttgcaatagaaattccttcgtttctaatatatctgtcgcgaaaagcgaggcgatatattggtagcttggagggccaaaatttagccctgtaggcgtataaaaagcatgcagtaacgtaagaggtagcaaaataaaatagaaggattttttactgctgcttaataagagaatagttattgtcgcaagcagaatgagagccacacttggttctgtaaacattccagaaccgattaaaataaaataacccgcgaatgcggcacaaatcactgcaaaaagtgcgggcaaaatttggcttgtttttttcgtgttatattgtcttccctgaaaagaaaatgtcgctattatccacctttcactgagaatttccatatttaacttcttcactcttgagcggttattttatagaataagccaattttttaagccagaaggaaaaaacaatgagccaaccaatttataaacgtattttattgaaattaagcggtgaagcattacaaggagaagatggtcttggtatcgatcctgcgattctcgatcgtatggctgttgaaattaaagaattagtggagatgggtgtggaagtcagtgtcgttctcggtggtggcaacttattccgtggcgcaaaactagcaaaagcggggatgaatcgcgtggtgggcgatcatatgggaatgcttgctactgtgatgaatggtttggcaatgcgtgattctttattccgtgctgatgtgaacgcaaaattaatgtccgctttccaattaaatggtatttgcgatacttataactggtctgaagctatcaaaatgttacgcgaaaaacgcgtagtcattttctctgcgggaacgggaaatccattctttaccactgattctaccgcttgtttgcgtggtattgaaattgaagctgatgttgtgttgaaagcgactaaagttgatggtgtgtatgattgtgatcctgcgaaaaatcctgatgcaaaactttataaaaatttaagttatgcagaagtgatcgataaagaattaaaagtgatggacttatcggcgtttactttagctcgcgatcatggcatgccgattagagtgttcaatatgggtaaacctggagcattacgtcaagtagtgactggtactgaagaaggcaccactatttgttagtgaatgttgaaaagaataatattaaagaaaatacataattaaattaaggactaaacttttaattcattgagtttagtctttttaatttaaataaagcattacggcaggaatgaaagttttcgtaaattctgtttagtcttcatagttggattatttagatataaaaatctgcactctaataagtgagaaagttaatcaaacttttagaatgcagattaattttttataaaatttcagtttaagctacagtgagttgtcccgcatataaaataaagaaacgtaaacaaaataccccaattaagtcaaaaattgataccaagataataaagttacgattgtattttaaacggtcatttacaaacatattggcgattaatgggatcaagataccaataatcaatactccaacccagaataccactccccaaaaaccagataaggcattatgtaacgcaactgttttttgtccgccaccaaaatgtaatccaacgaagaaacacacaatcaaaccaagttctgtcaccataattggcacttcaaatttgtggatgaagtgcgattcgtgagaatcaccttttagttttcctgcaattaagataattaagaaggttgcagcaataccagatgatgtgccagaagctaagaataatgcgggtaatactgggttatttaacattggatagctaatcaatgcagaaagtaagaaccctgtgtatgctccaagcacagcagccaatatgaaaagaataacttcgactggacttacaatacgttctgcaataccgatgagtttcatcacaaattgcagttttggtataaagcgattaattaatgcttcgatttcttttttgaaaatcactaccccccaaattactaaaaataacatatagatttggaatagcatgacccccatcgacattacggagttgaattgatagttaaacatcaatttccagaatgtccaaggtcgagttaagtggaaaattaatagcgttaaaccaattaatgttggtacagaccctaaaattaccccagatcgaataatccagttttggcttagattttctagtttattactgcgtttataggcaattgctaactgtaccgcaccagatgagatccccaataaaaacaagtagatcgcaatggtataatcccacactagattaggcgtatgaaatggaactggataatctaacgtcatcttctaggctccccatgttggaatggaatgtgatataagtttggttgtgtacctaattccactttagtgcgataaaccggtttttctttcactttacgtgaaactgcacttgttggatcattcatatccccaaaggttaatgctttggttgggcaagcctctacacaagcaggttgtttaccattggctaaatttgtatcgcggcagaagttacatttatctgcggtacgatgtattggatgaataaaacgtacacgatatgggcaaactgctatacagtattggcagcctatgcataaatctttatgtacatctacaatgccagtctctttatcaataaaagatgcaccagttggacaaactgctacacaaggtgcatttgtacaatgttggcaagattgacgaaagaactcgtattcttgatttggaaattccccataaggttcactacgtagaatctctaagcgagaaacgccttctggcacttggtttacatcacgacatgagtccatacaggctgtacaaccgatacacgcattttcatcatgtatcattgcgtaacgtttaggtttatctgccttgttttcttttgcaaaagcaggtaaagatgtccccgtcataaggatcactgcccccatgccagaaacaaagtttcggcgtgagcagactgtcatagtttatccttttgttcgattagtttatcttgttcagctttacgtttttgttgttcgccatgacaatctacacaaagtttaacgcgttgttttggttgaatacccttcattgcatcttctttagggtgaagagtatggcaacttgcgcaaggcaatttcattgcgtgtacatcatgagcccataatttttcacgaagtttgtcaggttgatggcaagcaaaacaaacttggttttgttcttgaacggaatacatcggttttttattaccgaaaatatctccttcaaaacgcataacatctttagcaccgcgacgatgattttcggaaatattgccgtgacagcttacacaagtaatagctttaccgttatttggatttttcttatctaaatgtgcaccgtgaaatttaccaaagtggagttcgccaccagactgatctagcgtttggtttttatctattttgtcgaatttatggcatttagcacaatattgattaggatcgcgttggttatctaattgcggttcataagtaacatgaaccgcaggtttttgtgcatcatccgcatgagccaaaaatggcgctgctacaaatgccacaattactaacgcttttgcagatttgttgattaaagaagttaaaatcatttgggttacctcaaatttgaccttgaaaatcaccgcactttctagtttgcactaaaaagtgcggngcatttttcatttatttttgtgctggtggatcaactaataagcctttttctctagcttgttgttcccattgtggtaccacagtttttaagaattcttctttcgctttacgttctttttcaatatcaatacccattactttccacgctttatcagcagttgaaatatctgggatttgaactggagttttcacaccgtgtttagttaagattactgcaagtttagtgcgtgcgtctgctactttatctaagccagaagctaatacacgaagtactacttcaggtgcatgcatatgaccaccatggcttgcagcagtgtaatcccaacgccattgagcatgacgaatatccattaatgctgcttccatttcttttttagttgcacctgcgtcccaagcctcttttgcttcaaagtgagctttgacaacttggtcttctaaacgacccattacatctttcacttcttttttacgtgaagtaacaatatcgcgtaatttttctttgctttgatcgtgacaatttgcacaagtgctgtcaaatgcctcaaatggattttgaatttggtgatcggtgtaaactttaccgtccgcaccttgtacttttggcatatggcaatctacacaagttaccccatttttaccgtgcatacctaaagaccaaatttcaaagtcagggtgttgtgcttttaacattggtgctttagaaagtgagtgagtccagtcagtgaaaccaatatcatcataatattttncaatatcatctacggtttgaccattatcccaagggaaagttacttgcttgatgtcccctgcaaaatagtattcaacatggcagtttgcgcaaatttctgcacgtttttcagtacgcgccgccgtgttgaagcttaaattgttgtgtgggcgaccttctgctttatctttttcagcagtggctttttctaaagcatcaagggcgcgtaatacgtgtgggcgagcaatacgtaatgcaggtttgccttctgnaaaatctttagaggttgtgtcgtgacagtcagcacagccaattgagttcacgatttcaggtcctccctttgcccatttcgcattgaaataatctttctcaccccattccgcgattaaacgtggaacatcaggacctttacatgtccaacatgccatagcttgagggccatcatttgcagtttttggcgcacctgtacgtaaaatattacgcacatctgttaccgcataaaagtgaccgcgtggtgcgttatattcttttgcaaatgcataaccaccccaaagtacgattaggcgcggattttcttcatcagcataaataatgttttcgccatcgccgtttgctgtagaacgccagctgttatattgatttggatatttttctgcaaatttttcatttacagattcaattttcaaatcaggttttgcgggttcaacaggttgttctaatggcttatatacaagctcagcagtggctgagttaaataagcttaaactcgcgaaagacgctgccacaataaggctttttttgaatgcgttcacgataattactccatttgttgtaataaaaaggttaagtagaaagttgagaattattattaatatccatacaaaacgtagatatattttcattcaagcgtaagataccaaaagaaaaaagtttttctactcgcagaatgctaaagtttgagcttgatcaagcttatcttttaaaatactcaaaaagaggtatattgttgttttaaataaattaaggcggtataaaaccgccttaattttgagtattattatcattagtattgactaataatattngctattcttttatctgatatttgatatttcgtacctaattgctgggcaaataaacttacgcgcaattcctcaatcatatagcgaatttctgctacttcatcggaaataggtttagattttggcagtttagcgagcaattgttggtaagcctgttgtacttgttccacgcgtagcatcgcagcacgatcacggtttacatcttgagccaacttatcaatacgtttatcaacggcttgcagataacgttgtaaatctggtaggcgatcataaccgctcttttgcacaaaaccttgatacaccaaacctgcaagttgcgatttgatgtcggataatgcaaatgccatcgtgaaatccattttgcctttaaggcgttggttaagttggtaagtgagagtaagaatctgctccactttctgcgcaatatccacggtcacttcgttaagattttctcgaacgaaatcacgcaatttttcaaagcctgcttcatcccaaacaaacccgccaaaatcggcaattagcttatctacggcacaagcgatacagtcatcgatcaaatccaatacgcgaccgaacggggtaaaatacagccccaatttggctttattcggcaatttttcatgaagatatttaattggtgatggcacattgagcagcaacagacgacgcaaaccttgctgcatcgccaccgattgctcaaactctgtttcaaacagtttgatacctacagcatctttttcatctacaatggcggggaacgctttgacgctgaaaccacgttgtttttgttcgtaacattgtggtaaatctgcaaaactccaaatatgcagcccactttgctcaatgccatcatctgccacagcagaaatactttcctgcacacgatcttttaagttgaatttcagctcatccaaattcatggattctgcgatttttttaccgttttcatccaccacacggaacgtcattttcagatggcttggaatttgttcccaattccaatgttccgcttctacggtgacgccagtcatacgacgcaattcataaatcagcgtatctaataatggcttttccaacggcaccgcacgacttaaaaaagcttgagcataattaggtgcaggcacgaagttacggcgataagatttcggcagcgatttaatcagcgcaatcaccaactcttcacgcaagcctggaatttgccagtcaaagccggtcatttccacttggttgagcaatggcaatggaatatgtactgtcacgccgtccgcatcggtacctggttcaaattgataagtcaatttgagttttaaattaccttgatgccagaaattcgggaaatccagcttgctcacttgttccgcatcatcattgatcaaaaatgaatgttcaaaattaagcaattcaggatcttttgctgcgcctttttccaccaggtatcaaaatgtttttgagagacaacttctgtgccaatacgctgatcgtaaaattcaaaaagcgtgcgatcatccaccaaaatatcgcggcggcggcttttgtgttccaattcttctacttctcgaacgagcctttgattttytttgaagaatttatgcttggtattccaacccccttccaccaaggcagattgaataaagatttcacggcttaccgttggatcaatagcaccgtaattactggtcgcacagccacaatcggcacgccgtaaagtgtgactttttcatctgcaatcacggcgccacgggatttagaccaaaggggttyggaataggatttttttattaaatgctcggcaagtggctcaatccattctggctcgatttctgccaccatgcgcccccaaagtttggaggtttccactaactctgccgccatcacccatttcggttgttttttgaaaagcacagaattggggaaaatcgcaaaatgggcattacgtgcgccaagatattgttgtttctccgcttcttttaaaccgatatgagaaagcaaaccacttaaaagtgcggtatgaatttgctgatattctgctttttcagaattaatcggcaagctcatttcacgcacggttaaacgaatttgatgataaatatcctgccattcacgaatgcgtaaataatttaagaaatctttttggcactgacgacggaattggtttttactcgattctttttgttgttcttgtagataacgccaaagattgaggaaagccaagaaatctgattttttatcggcaaaacgacgatgtttttcatcggaagcttgctgtttttcttgtggacgctcgcgcggatcttgaatggataacgcagagacgatgatcatcatttcataaacgcagccaaaattgaccgcacttaggatcattttggcaaggcgcggatcgactggaagttgagcgagttggcgaccaactctagttaataggcgtttttcacccgatttagtttgaacagtttcaaacgctcccaactcttccaacaacttcacgccatcttgaatgtgccgttcatctggcgcatccacaaaagggaacgcttcaatatcatccaaacccaatgccgtcatttgcaaaataacggaggctaaattggtgcgtagaatttcaggatcggtaaactctggacgagaattaaaatcctcttccgaatataaacgaatacaaatcccttcacttacacgaccacatcgacctttacgctgattagcagatgcctgtgaaataggttcaatcggtaaacgttgtactttggtgcgatagctataacgggaaatgcgcgcagtacctgggtcaatcacatacttaatgcttggtacggtcaatgaggtttctgcgacgttggtcgccaatacaatgcgatttaaaccgcttggatggaaaattttattctgttcttgtgcagacaagcgtgcaaagagcggtagaatttccgtgtgttttagattttgcttttgcaaggcttcggcagtatcacgaatttcacgctctccattcataaagatcaagatatcgcctcgaccttctgcttgcaattcatccaccgcattgagaatgccttgtagctgatcttgatcgtcttcttccactacgggacgataacgcacttcaacaggataggttctgcctgagacttcaataatcggcgcattgttaaagtgtttagaaaagcgttccacatcaatggttgcagaagtgataataagttttaaatcacgacgacgacgtggcaacaactgtttcagataaccgagaataaaatcgttatttaggctacgttcgtgggcttcatcgataatcaaacaagaatattgattgagaaaacgatcgttttgaatttctgctagcagaatcccgtcagtcatcaatttgatttgggtgttatcgctgatttgatcgttaaaacgaaccttataaccaactaaaccgccaagctccgtttccagttcttccgcaatacgcgccgccaccgaacgagcagcaatacggcgtggttgagtatgaccaatcatgcctaaattgccgaaacctaattccaaacacattttcggcaattgggtggttttacctgaaccagtttcccctgccaccacgatgacctgatgttcagaaatcagtttttgaatttcgactttgcgttggctaacgggcaaactctctggaaaaacaatcggattttgtaccgcacttttccgttgttctacacgtaatctagcttgttcaatttgctgctggatttcagcggcaacggcttgttgagcctcttggcttttaatttttccaataccatgaatgcgggcggataagcgacgttgatccaccagcatgatgtcatttaattgagaaaaaagagattgttgtaagggagttaatgtgtgttttaccgagctgtttttcatagcgatttacttttgaaacttccgtaagctaagctaatccatccgattaaaaataaagtsccgccaataggcgtaatccatacaattacattgcttgcttcgaaagcaagtgcgtataaacttccactaaataataagattccaattaaccaagaagacatagataatcgggcgaatttgttgtcacgtaaagcagataatgcaacggcaagtactgcaatggtatggaacatttgatattctaaccccgtatcaatccatgataatgctttggcttctaatatatggcttaagccatgagctgcaaatgcgcctagtgcgacacagaagaatccgcttaaagcaacaagagtaaggtatttgtttttcatttaaattttccctaaaagtaaagctaatatacctgcagcaataagtgggccaacgggaattccacctaaaaatgctacaccaataattgtgccgataagcaagccagtgactaaaatcggttgttcgcccattaaaggcacacctttgccggcaagccatgccacaagcacaccaacagaaatggaaagtgccattttccaactaagaaaacctgataaatcaggcaactgaattttccctgaaactaaggggcttaaaaccccaatggttaaaataatgataccaattttaacgccatatttttccaataaaggaatgtgagaagataaaaaagtttgctgcatgataagtaatacggcagcagaaatggtaattgtgctgttgttgcttaatacgccaagaataagaagtatcactagtaatagagcaatggtattgagttgtaatgtcataaagtgcggttaaaaaaatggaaattttggtaaatattctagcatagaaattcgtaaaattattttccattgttgttgagaaaaagataaatgagaaaagttaaaaagggttcattatgaacccttttatttagttggtaaaattcttaaatcatttattcctcaaatttaccttttttttctttattgatggtgcatttcgcgctagccaaattgcaaacaatacacccactacccaaatcgcatataacattctatttctccttagtataatgagtgtttatttttatcaatgaaattagcatctaaacgaccaaacatttttgagtaagaccaaatagtataagctaaagcaatgaccacaaaaacaactgcaaaaatcagcattaatgttaatgttaattcacttgaagtcgaatcccacattaataaactttgttcaggatgtgaacttgaaggcatcacaaatgggaacattgatactgctgcagtaataatcacaccagccattgttaatgcagagaagaaaaatgcaaaaccacaacgattagctttagaaaatgcagcatttaataatgcagcaactacagctaacgcagggaaaatccaaagaattggcatttcattgaaatttctaaaccacgcgccagtttctacagcaacttctttattcattggagacgatggagcgaaatgatcgatagtgctagtaactacataaccatctttagaatataaccatacgccagctaatacgaatgcaatcaaagtcacaatagaaccaatttgacttactgaacgagnacgatcacgtaaggcttcagtggttttcatttgtaaccagtttgcgccgtgagtgacaagcattgataagctaataacaccacataataatgcgaatggatttaatagctcaaaaaatgaacctgtataagtcacttgagttaattcgttaaaatggaatggaacgccttgtaataaattaccaaaagccacgccaaatactaatgctggtacaaaaccacctgcgaataatccccagtcccaaacagaacgccaagttggattatcaatttttgcacggtattcaaaacccaatggacgtaagantaacgctgccaagactaatactaatgcaatgtaaaaacctgagaaagatactgcatatacaattggccaagctgcaaatattgcaccacctgcagttaataaccaaacttggttaccatcccaatggggagcaatagtgttgatcataatacggcgttccacttcttttttacctattacaggtaaaagtgcggtcacgcccatatcaaatccatcagttacagagaagccaatcaataatacaataactaacacccaccaaataaaacgtagaaattcataatcaatcataatttatctcctacttatttagctgattgttcaaagtagtatttgccggtttttaacgcacttggacccaaacgcgcatatttaaacatcaaatacatctcaacaataatgaacgcaagataaagcgcacaaattaaaccaatagagaaccataaatcgcctgtacttaaattagaagcggatacgccaacaggtaagatctcgtaagtagcccaaggctgacgaccatattctgctaagaaccaaccacactcaatggcaatccaaggtaatggcaagccccataaaagaacttttaacaataatggaatttgagtgactttattacgtaaattttgaacaaatgcgccgaatgtaagtaaagcaattaaaccaccagctgcaatcattgcacgaaatgcccaaaaattagggcctacatttggaatagtatcacgagcggcttgtttaatttgttcttctgtcgcatcaacaacattgtttgtatagcgttttaataataaaccgaaaccaagatcttttttaacttcattgaattgtgctttggtttcttcatttacttgaccatttgcttttttctcagcgcgtagttgagtaaataattcataagcacggataccactacgtacacgagtttcatttaatgcttgaagatcttttagacctataatttctttatcaattgaacgagttgctattacaccgccaagataaggaatttcaatcgcaaaatcatttttcatttcagccgtatttggaattgctactggaaggaatggagcaggtgctgggtgagtttcaaattcagcttccattgcggctaattttactggttgtgctttaccaatatcataaccagattcatcaccaagaattagcactgaaatagaggcgataaatccaaaagtagcagctacggagaaagaacgttttgcaaattyaaaatcacgaccttttagtaaaaagtatgagctaatggctaaaacaaaaaatgcgcctgtcacataacctgcagaaagagtatgtaagaatttactttgtgcaacagggtttaaccaaagatctaagaagttagtcatttccatacgtacagtttcaaaattaaattctgaacctgttggtgcttgcatccagccatttgcaaccaaaatccacatagcagataaattagaaccgaaagccacacaataagttgctaataagtgttttccttttgataaacgatcccaaccgaagaaaaataaccccacaaaagtggattctaagaagaaggcaagtaacgcttcaatagcaagtggcgcaccaaaaatatcccccacgtaatgagaataataagaccagttagtaccaaattggaattccataataataccggtggtcaccccaagggcaaagttaataccaaataactttccccaaaattttgtcatatctttataaacttctttacctgtcgccacataaatagtttccataattacaagaataaaggataaacccaatgttagcggcacgaaaatgaagtgatacaacgcagttaaagcaaactgcaagcgagaaagatcaacaacgtctaacattctcaactcctttgtataaacaacattagttccaacaatgattaacaaggcgatgccttaaataatccctaattactcaactccaatcagctaagtttaaattgacttatctacataattatttttaaaggttaaaaaaacaccagttattatagagataatccaaattggcggctattctactactaaacataaggataaaaaatagtaaaaaatgctatatagatcacatttttgatataaatacaaaaatagggcttatttgttatattttatttaattgacttagatcaaattgacatttttgcaataatttttgttttaaagatgattaatttcattgtgtaagatcatattttaatatttgtctcaaccaacacatctcttgatgtttttaactgcttgaataagtatgtrgtggcatttaatacttaatttatcattcaacatttgtaatgtgattgtggatcctttccaaggataaaaaggattaagccaaaactagcattgagttcattgcgcaaatcaggtaaactaccatcccgtctttgatagctaattatcttcgatttttgaccgcacttttggttgattttgtctgtaggatgattagctataatcatttatattccaatacagattaggttccctatggctacaaattatatttncgtcactggcggtgtggtttcatcgttaggtaaaggcattgcggcagatcattggcggcaattttagaagcacgtggtttaaacgtaaccattatgaaattagatccatatattaatgtggatcccggtacgatgagcccaacccaacacggggaagttttcgttactcaagatggcgcagaaacagatttagatttaggtcattatgagcgtttcatccgcacgaaaatgaccaaacgtaataacttcactacaggtaaaatttattctgaagtattacgtaaagagcgtcgtggcgattatcttggtgcaacaattcaagtgattccacatatcactaatgaaattaaagatcgcgtcattgctggtgctcaaggtcacgacgttgtgattgttgaagtgggcggcactgttggggatattgaatcacttccattcttagaagcattacgtcaattagccgttcaagttggtcgtgaacatacgttatttatgcatttaaccttggtgccttacattccaacggcgggagaggtaaaaactaaaccaacccagcattcggtaaaagaattgctttctattggtattcaacctgatgtgttgatttgccgttcagatcgtatgattccaccaaatgaacgtgcgaaaattgctttattttgtaatgttgcagaacgtgcagtcatttcattaaaagatgtgaattcaatttatcaaatccccgcattattaaaatctcaaggtttagatgattttgtctgtgaacgtttccgtttaacttgccctgaagcagatcttactgaatgggaacaagtgctttacaagcaagccaatccagtgggagaagtaaccatcggtatggtaggtaaatacactgagttacccgatgcctataaatcagtaaatgaagccttaaaacacgcaggtttaacgaaccgtttaagtgtaaacattaaatatattgattctcaagatgttgaaaccaaaggtgttgaagtattaaagggcattgatggcattcttgttccagggggatttggttatcgtggtgtagagggtaaaattcgtaccgcacaatatgcacgagaaaacaaaattccttacttgggtatttgcttaggtatgcagatcgcattgattgaatatgcacgtaatgtagcgggtttaactaaagccaattcatctgaatttgataaagattgtgaacaacctgtggtggcattaatcacagaatggcaagatgcggagggtaatactgaagtgcgtaccgatgaatcagatcttggcggaacaatgcgtttaggcgcacaacaatgtcatttggtatcaggtagccgcgcccgcgagctttatggcaaagaaaccattgaagagcgtcatcgtcatcgctatgaagtgaacaataccttgcttccacaaattgaaaaagcaggattgaaagtaactggattatctgcagataaaaaattggtagaaattatcgaagtgccaaatcatccttggtttgtcgcttgtcaattccatccagaatttacttctacgcctcgtgatggtcatccgttgtttgcaggctttgtaaaagcagcctatgaaaatcacaaaaaatctgtgaagtaattcttggttctgcaataagtgcggtaaaaaaatgaaatatttttatttggttatgatataacttgatgtttttgaagtaaaaaaatccccgttaaatttatcatttaacggggnttttttataagctatttactgtttttatatttagttagtacgcttaactaatttcgtccagttataataaccatacaacgagttaagtaagtaggctgaatacattaagtatattgcaggtgtctctgcccataagaaaatagaaagaatatttaatccaatccataacaaccattgttcacgataacggcaaaatcattaaaatctgtgccgcaaccgtaataattgtagttagaccatctaaacctgttgagctaccaccagccgcttgtaatgcttgaacaaaaagcaaagtaccaaccgtagtcacaacaattaatgtcatccatcctttaacagttaacgcttttgcaatcacgctttctccaccatcgctattttgcatattggctttccacataaagtaaccaataaattgagagggnaaatatacgtaaagtacggtgttcatttcgcctaagaaattcgatccccaagcaacataaaaataagtataggcaaaaatcaatccaaagaaataattactaattttacctttacttaccaataccacacacaaaataccagaaataccagaaatcattgctaaccaagaatcaggtgtttgtacataagcccaaatttgcgcaatgataaaaagcgcaagccaaacccacctcaaaaggtttccaaccagaaacaaattcttgttttaaacgcgctgccaaagtcattatttactcctattgacttaaattttgaggtgaccattttcgcattgtgaattggtaatgtcaaggtgtagaagcatttaattctaaagttgtgaaatccatcacgttttaattaaagcctacattatctattattgagtttgtttcaaaaaacgctctaaaaattgaccgcactttaaatataataatcaagctcaagtggtatttttgcttgtaacaagaactgtttagtacgctcgtgttgtgggcaagtgaagaatttatctgctgtattttgttctacaatatgtccatccgccattaaaatcacacgatccgcgacatctttcgcaaactgcatttcgtgagtaacaataatcattgtccagccttcttgggcgagcatttttagtgtttgtaacacttcgcccaccaattcaggatctaatgccgatgtaggttcatctaataaaataatatcaggttttaccgcaagggctcgagcaatccccactcgctgttgctgaccgccagaaagttgggatggaaataaatccgctttatttttaagccctactttttctagcaaactaagtgctttttcacgagcttgagctttatcttgtttttgcacaacaaccattccctccataacattttcaagggcagaacgatgagggaataaattgtattgctgaaagaccattgacgaacgtcggcgtaacttcaattcatctgctttactaattttctggctaaaatcaatttttagactgccatcagtaaattccaaaatgccttgctctggtcgttcaagcaagtttaaacaacgtaaaaaggtggtttttccagaaccagaagggcctaaaattgcgaccacttcgcctttattaatttcaaaatcaatgccttttaacacatgattgccattaaagtttttctgaatattacttacttttaacatagacattccttataaatggcgagataagcgaatttcaagacgatcttgtaagaaagataaaacaaaacagaaaatccaataaatcaaagctgcctcactataaattaaaataaattcatagtttgctgccgtgatattctgtgcgacacggaataattctgtcactaaaacaagagaagctaatgaagtgtctttcactgtactaataaaagtattagaaagcgatggtactgaaatacgtaaagcctgtggcataattgtacgaataaatgcttgtcgataattcatacctatcgcataagaggcttcccactgccctttaggtatagcaataattgaagcacgaacagtttctgctgcataagcacctatattaatagaaaatgcaataatcgctgtcggaaaaggctctaaagtaataccgacttcaggtaacccataaaaaataataaaaatttgtactaacatcggtgtacctcgaattatagagatatacactcgacataaagcctgtaacaattttaagggtaaattaggactaggcaaagtacgaataactgcaacaatcactgcaataagcaaaccacagaagaaggaaatgactgccaatggcaatgtgtataaaattgctgcttccaacataggccaaaacgagctgattacatactcagctcgttctgcactcataaatggaagactcgccaaccaattattgagtaatatcataaccaaaccattcaattgaaatctgttttaatgtaccatcttggcgaagtgcttcaagtacttgattaaattttgtaatcaatgcatcttcaccttgtaaaaaagcaaaggcagtcggagttttatccccacgatcataagcaatttttaaaccagaatttgggtgttgtttaaaataatctaatacagccaatttatcattaattgttgcttctgcacggccttgtttaataagctctaagctctgtgctaaaccatccactacaagaatctgcgcacctgcagcttttgcatctttaccccagttacttgttgcagattgcgcagatttacgacctttcaagtcttcaaatgatttaatactgttatccgatgattttgttacaatcaccccaccagaataattataaggcgttgtgaaactgtatttttttaaacgctctgggcttgggttagtttggtttgcaatcacatcaaaacgttttgcatttaaccccgcatacattgcatcccattgtgtttctttaaattccactttcaaaccgagcttttcagcaactttacgaataacctctacatcaaagcctgttaattttccacttttatcatggaaagtaaatggtgcataagtcccttctgttccgactaataaagttttcgttttttcaacacgatcggcaatttcgcctgcgtgagaaaacgttgagaaagcaatagctccagttaaaagtgcggtcgtaaaaagtaattttttcattttttcttccttgtgttgtgtttgtctaagcgtgattataaaaaccaaacttatgaaaaaaaaagattatttatttatggtttatgaattttagttataaaaaattaatataagtgattactatcaaaataagaaaataatctaccgcactttcttgtagaaaaatacgtttctaaacaatgcaatcaatctactcttataaaatttcagtaaaaaaatgcctttctaaagaaaggcattaatagaaatttaagattataaataaacttgtaatgtctaatagaaaagcagcgtatctaattacgcttcatcacttccagaaaaacgttcaattttcgcacctaggccacgtaatttatcttcgatatgttcataaccacgatcgatatgataaatacgatctacaatggtttcacccgttgcgatacaacctgcaagcactaaactgattgaagcgcgtaaatctgtcgctattacctctgtgccagacaattgttcaaccccgtgacataccgctgtattcccttcaatttcagctttaccacccatacgaattaattcaggaatatgcataaaacgattttcaaaaatcgtttcagtgataatgcttgtaccttctgccaccatatttaataaagtaaattgagcctgcatatcagttgggaaccctggatgtggtgcagtacgaatattcactgctttagggcgattaccaagcatatctaaagtaatgctattttcagttacatcaacttgcgcaccagcttcacggagtttatcaattacggcatctaaagtatccgctttagtattttgacaaacaacacaaccgcccgaaattgctgcagcaattaagaatgtacccgtttcaatgcgatctggcacgacactgtgctcacaaccagttaaacgttcaacaccttcaatcgtgatgtgagcagatcctgcacctgttattttcgcacccattttattaaggaaatcggcggtatcaacaatttcaggctcacgagcggcgttttcaataacagtcgtacctttcgcaagggttgctgccatcataatagataaagtggcgcctacacttactttttctattacaatacgagttcccacaagacgatccgatacttgtgcttttacatatccttcttcaagaacaatatccgcacctaatttttctaaaccgctaatatggagatcaacaggtctagccccaatagaacaacctccaggtaatgatacttgaccttgatggaaacgagcgactaaaggtgccaatgcccaaattgaagctcgcatagttttaaccaattcataaggtgcagtgaaatgattgatattagaggcatctaataaaactgcaccagttgcatcacgatctacaaccacgcctaattgacgcaaaattttcaaagtagtttcaatatctttaagttcgggaacatttgtcaatttaacaggttctgtcgctaaaatagccgcaaaaagaattggaagtgcggcgttttttgcgcctgaaatattcacacttccacttaaacgagattgcccataaacacgaaatttatccatttttaaatccttaattaaactggtttaatgcacgatcgcgtttccatttttctacggtataagttttgatggttagagcgtgaatttcaccagtactaaaataaggcattaaaggggcataaatcgtttgttgttgttttacacgagatagtgcagcgatttcatcactcacaacaatcacaccaaaatgtgcattttcaccttgtgcatagacttctgcaatatttagtgtgtcttttaaaatttgttcaattttttgaagttccatcggatttccgtttagttaagctatataaaatttgcgatccaatcagataaaccaaagagatctgctagggttaataattgttttggtggataaactaatcgcactgttttattaagcttttgacactctcgtaaaaaatcacaaagagctgcaaaaccagcagaatcaatatgctgaagatcagacaaattccattcaacaatagttttatcaagtgtacttgctgacaaaaaaacgccacgttgctgccacattggtaacaacgtgctgcgagatagttccccaaacaaaaagagcgttattttatcattatttttttgcaaatcccaatttagcatagttattcatttattgattgaaaattataggttgtgaggcagattgctgcatctttgtgattaatgtatcaataccttgtttgtttaaaataccaacccaattttttatcgtatcttccagcatacttacgcctgctcccaccatatcataaactttccattccccacttttattgcctttacgccatttaaaatataacaagattggggcaactccgttagcttgaataatatttacgcgaatatttataaaattgttatcgcctaattctttttctgattcaatttgaattttttgattagaataatttgttaatgcttgtgcatacttttgctcaatcaattcgccaaaagttttgaaaaatttttcgcgttgttctgcagaggttgatttgtagtatgaacctaatactttagaacctgcatattctaagtttacataaggcaataaatcattacgaacaatagtacgtaaataatttggatcttgtttaattttactttgattagcttgtatatcagaaaatagtttatctgccgcttgctgcattaaaacataaggacttgtttctgcaatagctgttcgtgtaaccaaaaatgcggttaatacgaaagttaaaatggtaaaccatttttttagttgaataaggttcattatcaatctcctaatttataaaatttaacctattgttctgtggattctgatttttcattgccgtccgattttttacttccatataagaattgcccaattaaatcttccaataccatagctgatgtagtgtcttgaatctggctaccatttttaagcattgctgtatctccatcatcaaaacccattgtcaaggcaatatattgctcacctaataaacctgatgttttaattgataaagaactgttttctggaatttcattatattcttgattaatcgcgatgcttactttcggtaaatagcttttttcatcaagagtaatagcactcacacgtccaattactacgccaccgatttttagtggtgcacgtactttaagtccaccaatattatcgaaagttgccgtcacagtataagatttcgtctcagcaaaaccttgtacgttggctacgcgtaaacctaaaaaaactaaggcaccaataccaagtaataaaaataatccaacccaaaattcatatttaattgtttgtctcataaaaaaatccttaacctgcgccaaacataatagcagtcaaaataaaatctaatcctagaacaacaagcgatgcatgcacaactgttcgcgttgtagcttggctgataccttctgatgttggcatacaatcataaccattgaacagcgcaatccaagttacggctacagcaaagaaaaccgctttaataaagccatttaaaatatcataactccaactcacggaattttgcatcacagaccaaaaactgcctgaatcaacacctttccaatctacaccgactaaagaaccaccccaaataccaattgcgataaacaagattgataaaactggcatagaaatgacacccgcccaaaaacgaggtgcaatcactcgacgtaaaggatctaccgccatcatttcaagactagaaagttgttcagtggctttcattaagcctatttcagctgtcaatgcagaacctgctcgaccagcaaataaaagtgcggtaacaacagggcctaattctcgtaaaagagaaagtgctacaagctgccccaaacttgtttcagcagaaaaatcgattaacacgacataaccttgtagccctaataccattccaataaataaaccggacaacaaaataatgagtaacgattggacacctaaaacatgcatttgcttcacaagcaaaggaaaatgcttgcgaatttgtggcttgccgatcaatgcgccaaataacataaagcctgctcgccctaatgcacggaaaaagtcgatcacctgttttcctaaagcagaaataaaattgacgatcattcaaacaattccttcacataatcttgcgctgggtacttaaagcgcacaggaccatcagattcaccttttaagaattgcaccactcgcagatcttggctttgtaaaagctgctcagatgttccttctgcgatgactttttggtctgcaataatataggcataatctgcaatactcaatacttcctccacatcgtgcgacaccacgatagaagtcaaatttaacgcttcatttaatcgtttaatcaggctcaaaattacgcccatactgattggatcttgcccagtaaatggctcatcaaacataattaaatcagggtcaagtgcaatagcacgtgctaatgcagctcgacgagccatacctccggaaagttctgaaggcatcaatgcggcagcacctcgcaacccaactgcctccaatttcatcaacacaatttggcgaattaaattttcaggcaaatgcgtatgttcacgaattggaaaggcgacattatcaaaagtagaaatatctgtaaaaagcgcacctgattggaataacattcccatccgcttgcgtacttcgtacaattcacgattagatagacgacaaatatcttgcccatcaaacaaaatttcaccttgttctggcattagttgcccaccgatcaatttaagtaaggtggtttttccaatccccgacggccccataatcgcagtgatttttcccttttttacttgcaaattcaggttatcgtaaatcacgcgatcaccgcgtttaaaggtgagattcttaacttcaattaaattttgattcattaatatctcgtttataaataaaaagttcaatcagttttatatgacctgaaaaagttagatttgtttaatttaaagatgaagttttttcttttatcgcaacacatctctttggtttaactttgatgtggtcataaaaatagtgataaattttatttctattttttatagattaaaatttttgtaatagtaacattctttttgacctcactaaagaagctttacatttcttcattatttattgaattttaataatactttgtttatggaaaataaacattgataaatgcttataaataataagcctgtaaaagatacagatttgataaaaaagattgcaagagaaaagttatagagaggaaagttatagagaggaaagttatagagaggaaagtagaaaaacctagcttttgctaggcttttctatgtttattattttgcgcaattgctgtgtgctgttttttgttcaaaacgttctgcaacgaaatcccagtttaccacgttccagaattctttaatgtagtctggacgacggttttggaattttaagtagtaagcgtgttcccaaacatctaaacctaaaagtgggaaaccttcacaacctgccacttctttacccattaatgggttatcttggtttgctgttgatactacggctaatttaccttcagcagttaatactaaccacgcccaaccagaaccaaaacgagttgctgctgctttttcaaactctgctttaaatgcatctacagaaccgaaatcacgttcaatcgcatcttttaatgcgccttgtaaagtagtgccttttttcaagcttttccaaaataaactgtggtttgtgtggccaccagcattattacgtaatgctccacgtttttctgcaggaattttatcaaggttagaaattaaatgacccggatacatttctactaattcagcgggtaaaccttctaatgcagcatttgcattgtttacgtaagcttggtggtgtttactatgatggatttccattgtttgcgcatcaaaatgtggttctaacgcattgtaggcatagcctaattcagggagagtgtaagacataatgtattccttctattgttaaaaacagatttcgttgaggttttggtctataaccaaaattgagcaaataatagcaaaaaaattgatttagatcattaaatgtttttccttttttaaaaagtgaatttattaaattttgttttaaatcaataaacctatcgatctacttctaaagagttatgtgtttgagttgcgaaaatttcatcaaatattagaatactgtcactttctattttccctctgtaattatgtttgagcaacacaagttatctctgcaaaatttatcctgccaacgtggtgagcgcgtactttttcgtgctttgacttgcgattttaatagcggtgattttgtacaaattgaagggcataacggcataggtaaaacaagtttgttacgtattcttgcgggtttagtgcgacctttggaaggcgaagtgcggtgggattctgaagcgatttccaaacaacgtgaacaatatcatcagaatttgctttatttaggtcatctttctggtgttaaaccagaattaaccgcatgggaaaatttgcagttttatcaacgaattagtcaagctgaacaaaacaccgatatgttgtgggatttgcttgagaaagtgggattgctaggtcgtgaagatttgccggctgcacaactttctgctgggcaacaaaaacgtatcgcgttaggtcgcttatggctgtctcaagcgcccttatggattttagatgagccctttactgcgattgataaaaaaggcgtggaaattctaaccgcactttttgatgagcatgctcaacgaggtggtattgtgttgttaaccagccaccaagaagtgccaagttctcatctgcaaaaattgaatttagcggcttataaagcggaataacttaatgatttttttagagataattaaacgagaacttcaaattgcgatgcgtaaaaatgcggaaattttaaatccgctatggttctttttgcttgtgattactttgtttccgcttgttattgggccagatcctaaattactttcccgtatcgcaccgggtatcgcatgggtagctgcattactttcagcattgctttcttttgaacgtttattccgtgatgattttattgatggctctcttgaacaattaatgttaaccgcacagcctttgccaatgacagctttggctaaagtggttgcacattggttgctcactggtttgccgcttattttgctatcacctattgcggctttgttgctttctcttgaagtgaatatttggtgggcattagttttgacattgttactgggcacccctgtattgagctgtatcggtgctattggcgtggctttaacggtgggattgcgaaaaggtggcgtgttgttgagtttgcttgttgttccgttgtttattcctgttttaatttttgcttcatcggtattggaggcagcaggattaaatgtgccttatggggggcaactggcgattttaggtgccatgatggttggcgctgtaacgctttcgccttttgccatcgcggcagcgttgcgaattagtttagataattaattttattcatcgtataaaagtgcggtggtttttctctttaatttttaaggattttttatgtggaagtggctacatccttatgcaaaacccgaaactcaatatcgtatttgcggtaaattgagtccgctatttgcatttttaacgcttgtcttactcggtgttggcattgtatggggtttagcattcgccccagcagattaccaacaaggtaatagtttccgaattatgtatgtacatgcgccgacagcgatttggtcaatgggtgtgtacggttcaatggcgattgccgctgtggttgccctagtgtggcaaattaagcaagctcatctcgcaatgattgcaatggcaccaattggtgcattgtttactttcttatcgcttgttacgggcgcaatttgggggaaaccaatgtggggtacttggtgggtgtgggatgctcgtttaactgcagaattaattttattctttctttatcttggtatcttagccctttattctgctttttcagatcgtaacataggggcaaaagcggcggggattttatgtattacaacggtcgtgattttaccgattattcatttttcggtggaatggtggaacacgttacatcaaggtgcgagtatcactaaactggaaaaaccatccattgcaattccaatgttggttccattaattttgtgtatcttcggttttttaaccttgtatatttggcttactttagttcgttatcgcatggaattattgaaagaagatgcaaaacgtccctgggttaaagcattagctcaaacactgaaataaagtgcggttagtttttagcgattttttataaggaatattttatgtttttccaaacttggagtgatttttttaatatgggtggctacggtttttacgtatggttatcctatgcagtaagtttagtggcagttattgccttaattgttcaaagcgtcaagcaacgcaagacagtattacaaaatgtcttgcgtgagaaacaacgcgaagaacgtttacaacaagcaaataaggggaatacactatgaatccaagacgtaaatccagatttaaattagtcatttttgttgtgctcggcattgcaattgcaagtggattgatgctgtatgcgttacgtcaaaatattgacttgttttatacgccatctgaagtgatccaaggtaaggataataaccctaatcaaaaaccagaagtggggcagcgtattcgtgttggtggtatggtggttgaaggcacggtagtgcgtgatccaaaaagcttaaaagtgcggtttgatttaaatgatattggtcctgcgatcacggttgaatatgaaggcattttgccagatcttttccgtgaaggacaaggtattgtggctcaaggtgtattaactcagccaactgttttaactgcaacagaagtgttggctaaacacgatgagaattatgtgccgccagaattaggcgaaaaaatgcaaaaagtacataaaccaatgggaattgaggcagcggacttaaaaggcgaaagcgcgcgtgatcgtcaagaaaaagaaggcgcaaaatgattgctgaattaggaaattacgcacttgctttaagtttagctgtatcgcttatgttggcgattttccctttgtggggggcggaaaagggcaatgcacaattaatggcattagctcgcccaatgacttatggtttatttgcaagcctaagcattgcttttgctgcgctattttatttattcgcagtcaatgattttagcgtgcaatatattgtaaataattctaatactactttacccatttattatcgtttatctgcggtatggggttcccatgaaggctctttgttactgtggatttggttactggcggtttggtcatttgccgttgctttattgagtaaacatttaccccaagaagcggttgctcgcgtgcttggtattatggggattattagcgtcggttttgtattgttcgtcttgtttacctcaaatcctttcacgcgtactttccctgatttcccagtggatggaaaagaacttaacccaatgttgcaagatgtaggcttgattttccaccctccattactttatatgggctatgtgggtttttcggtggcatttgcgtttgcgatagcatccttaatgactggaaaattagattcagcttgggctcgttggtcacgtccttggacgcttgctgcttgggtgtttttaactttaggtatcgtactcggttcttggtgggcttattatgagcttggctgggggggctggtggttctgggatccagtagaaaactcatcgtttatgccgtggcttgctggtactgcattgattcactctctttctgtgacagaaaaacgtggttctttcaaagcttggacggtattacttgcgattttagccttttcactttgtctgctcggcacattcttagttcgttctggtatcttagtttcagttcacgcatttgcatcggatccaactcgtggtttgtatattttggcttacctcgttgtggtaattggcggttcgcttgctctctatgcgtataaaggcagtcaaattcgttctcgtgataatgcagaacgctattcacgtgaaagtatgttgttattaaataatatcttattaatgaccgcactttgcgttgtattcttaggaacgttgttaccacttgttcacaaacaacttggtttaggctctatttctattggtgcgccgttctttgatcaaatgttcttaattattatgacaccatttgcattattgcttggtattggacctttagtgaaatggcgtagagaccaattttctgcaattcgtacgcctgttgttatctgcgtatttgttatgctgattgcaggttttgcgttaccttatttcttgcaagataaaattaccgtgagttcagtgcttggttcaatgatgactgtgattattgcgttacttgcgctttatgaattgcaacaacgtgcgacgcatcgtgaatcattctttgttggcgtacgcaaactatctcgttctcattggggaatgatgttagctcacttaggcgtagcaatgactgtttgggggatcgcgtttagccaaaactttagcgtagaacgtgatgtgagaatgaaagttggcgagagcgcacaaattggtcgttacgattttaaattcactggtgtgacggatgaaaatggtccaaactatattggtggaaaagctcaaattgatatttctaaagatgggcaaccagaggcgagtttattcgcagaaaaacgtttttacacagtaagtcggatgtctatgacagaagccgctattgctggtggtttaactcgtgacctttatgtggcacttggcgaaaaacttgaggataattcttgggcgttacgcttatattacaagccatttattcgctggatttggattggcggcttatttatggcgttaggtggattgttgtgcatgttcgatcgacgctatcggtttaatgtgttgttgaagaaataattttattcttgccttcccctgcttgcgggggaaggtgcccgaagggcggaagggggattacgtatccccctcagtcacttcgcgacagctccccccataaatgggtggagcaaagttaatgaaaaagtgcggtaaaaaatgaaaaaaaaattactcgttcctcttattctctttttatcaataacaattgcctttttagtgcaattaaaacgcaatgcgcaaggtgaagatattaaagcattagagtcagctttggttggaaagcctgtgccagcaaaaaatttgacggagttgtttgaaaataaaacttacacgaatgaattgtttcaacaaggtgagccagttttgcttaacgtatgggcaacttggtgtccgacttgttatgccgaacatcaatatttaaacaaacttgctaaagagggtgtgagaattatcggtttagattataaagatgaatcacctaaagcaatgaagtggttaaaagatcttggcaatccttatcaagttgttttaaaagatgaaaaaggttctttcggtttggatttaggggtatatggtgcgccagaaacgttcattgtagatggaaaaggtgtgattcattatcgttatgctggagatgtaaacgaaaaagtttggactcagactttaaaaccaatttatgacaaactttcggagcaacaataatgaaaaaaacatggctatttttgaccgcacttttgtttagctcggtggcgttttcagctattgatgcattaaattttagttctccacagcaagagagtgattaccatcaattaacacaatctttgcgttgccctcaatgtcaaaataacaatattgcggattccaatgcgactatcgcagtggatatgcgtggcaaagtatttgagcttttacaagaaggcaaatcaaaaaatgacgtagtggattatatggtggctcgctatggcaattttgtaacctatgatcctcctataacagcgagtacattagtgctatggattgcgccattattgcttgtgttgttaggcgtggtgtttttattaagacgcaaacctaaaacccaaagtgcggtgaaatcccaagagattttaacggatgaagataatgcacgtttggcagaattattaaacaaggataaatagatgaattttacattaatttttatcttaaccactttagttgtggcgttaatttgtttttatcctttattatgtcaattcaaagcgaaacatgggcaaaaacgtgatgatttaaataaggcgttatatttctcgcgcttggaagaaattgagcaagataattcccaaggtttagttgaaaatgttgagcaacttaaacaagaattacagaaaaccttgcttgatgatgtgccgagcaaggttcaagagaatgtggattattctggcaaatcttatggaaaaatttggtttatctctggtgtattagcgttaggaattatcgcaggtccttcttattttatggtgggatcttggcaagccgaatcaatgttagagcaaacttatgcgaaattgccctatttctttgaccgaatgaaaaatgaagataaaaatccattttctgatacagaaatgcagcaattttctaccgcacttcgaatcgatttgcaaaaaaatccaactgatgccaaaaaatggtggatgctcggtcaaattgggatgaatttaggtgatgcacgtttggcattcgatagctatcaaaaggctaataaacttgaaccagataatgtgcaatataaattaggctatgcgcgtatattgatgttttctgaagatgcgactgataaacttaaaggtggcaatttattgcgtgaagtgattcgtcaagaacacactaacattgaagcattgagtttactcgcattccgttattttgaaacggaagattataaaatggcggcagtgacttgggcgatgatgctacgcttaatgccgaaagatgatgagcgtgttcctctaattgaaaaaagtattcgtaccgcgcgtgatgctttagaagcgcaaaatgaagaaaaatcaaaaagtatcactcccgaaaaataacctagtacgttataagactttttgatatagtgcgaaaaaattattcgtagtcgaacagattagcatttaataaagtactaaaggaacgagaaatgaataataaaaattgcacttttttctttgttctgcgtcattattggaagtttatttacttcacaattttcgattgcagaaaatgattctagtgcagtcacttatattgattctgaagataaaaaagcatttaattccgatgtttcaaataatgattctcaaaactagctcaaagtattgaatttaaagtttataaaatagatgaaaccacttcatcagaaagtatttatgaatctccagctggaatttgtcagggatttaagattacaaaaggtgtagattacacaaattcgacttaccattatctttatccagacaatagaggagaattctatggcagtgtggctggtgcactatttataaccaaaaagatcctcaaaatttaagttatgtgccagtttattcaattacagataaagatttatctaagcgtattcagttaaaagaaaataaaacattaaaggaaaaaacagcgaattatgtatcagaaggtagggctgtattaactgacgtaatttgtaaataggatgtatttaatgagaaaaatagtttttgttagttgtgtaattttaggtttagcagcatgttcatctcaaccagaacaaattggtggcggtgtttacgatatgaaaactgtgcaagaatataatgctcgagttattagtggtaatactgttacacaaactcaaaaggataaaataacgcaacaaattgatacaagtttaaaattaaaccaaagtgacaataaagttaaaacgagaacaagacgtgtattgcctgtccttcctgtcacaccaagcgtcggatatcattataattatcactattttagataaaaaattatcttgttatctgtgctaaaaattcttcttctgttagtactgtaatatttagttcttgagcttttgcaagtttagagcctgctgcatcacctgcgataacgaaatctgttttactggataccgaaccacttacttttgcaccaagctgttgtaataaggcttttgcttcattacgccccatttgtgtaagagtgcctgtcagtactacagttttatctttgaacaagttttcacttgcttctttcacttctacagtttcccaatgcacaccttgtgcgattaaatcctccacgactgcaacattatgcgcttcacgccaaaatataaaaattcggttcgctacaacttcccctacatcaggcacttgttgaagttcttcaagatttgcgtctttaagcgcatctaaagttttgaaatgattagcaagatttaatgcagtggcttcgcccacttcacgaatgcctaaagcaaaaataaagcgagcaagcgtcgtgctttttgcattttcaagactattgagagcgttttctgcagattttgcacccattctttctaagcgtgtgagcgtggttaaatcaagtttaaataagtccgcaggtgtatgaatcagttctcgatcgactaattgctctattaattttccgcctacaccatcaatatccattgctttacgagagacgaaatgttttaacgcctctttacgctgtgccgcacagaataatcctcccgtgcaacgtgctactgcttcgccttcaatacgaataatttgagaatcgcacacagggcaatttgttgggaaaatgattggtttagcattatcagggcgacgttcgtgtaatacgccaataatttgtggaattacatcgcctgctcgacgaataacaacagtatcgccaatagcgatatttaaacgttcaatttcatcgccattatgtaaggtggcattacttactgtaacgcctgcaacaaacactggctctaatttggcaactggtgtgattgcgccagttcgacccacttggaattcaacatcattcaacagggttaattcttcttgggcggggaatttataagcaatcgcccagcgaggtgctttagaaataaatcctagttcattttgtaaggctatatcattgatttttaataccgttccgtcaatatcataacctaacgagctacgtttgttttgaatatctcgataaaaacctaaaacttcatctgcaccattgcataaacgaatttcaggatttactggaatcccgatagattttagccattgcaaacgagcataatgcgtagtcggcagatcaaccccctcagcaattccaataccataagcatttaataccagcggacgtttgctggtaatattaggatcaagctggcgtaaagagcctgccgctgcattgcgaggattagcaaaggttttttcattatgttctaacgcatatttatttaaacgctcaaagcctgcgtgcggcataaaaacttcgccccgcacctctaaacgtgctggaggattatctgttaaaagttgcaatggaacattacgaatcgtgcggatattggctgtaatatcttcgcctgtggtgccatcaccacgagtggcggcttgtgtaagttcaccattaacatacaaaatactcacagccaagccatcaagtttaggttcgcaacagaaagtaagtggtttcggtaataggattaaacgatcttcaatgcgttttacaaaagcattaaattctgcatcggaaaaagcattatccaaagagagcataggaatttcgtgacgaatttggctaaacccagaaagtggttttgcaccaacacgttgagtgggcgaatctgacgtcagaaattcaggatgctctaattctagggctttgagctgatgaaataaacgatcgtattcgctatcaggcacactcggattatctaaaacgtggtattcgtattcatattggcgcaaggttttgcgtagattgtctagttgagtttgaatatttgtcataaaattctcggagaaaaatgaccgcacttttctatgtatttagcgtgaaaatagacaggtacacagcctgtctaaatgaatataaaagtgcggtaaatttaaggtatgaatttacacacgagcaagataggcttgctctgcatttgcatcaaaaatttcttgttcttcagtcagtataacaccttgtaaatcttcggctaatgtatgggcagcacgcatcatcatacgtaaattagcaagattattacctggagagggcaattgcataaataatacaattcctatggtgttaaattccgctaagttataagcattgaatgtgccgggttgttctaaattggccacactaaaaagcacaggacttgccacacttaaatctaagtgacgatgatacatttcatctttacccaagataaaacccaagttttcaagagcctgcaccaatttagcaccattaaattcttcgctagattttggaataagataaagttgaatatagccagttgtttgttttggatgagctgtcgtttctgcttttggttcattgaacgagaggttgtagtctacttgatgttcttcgtgagataattctgcaagctgcactcttaattctggcgatgatgaattaatgccattaaaaccaacattttgactttgtgcttcaagttgttctaaggtcatacttgcgacattatttgcggttggcatatcgtattgaggttgcgttggttgtattggctcggaacgatgattccccatatcataaataggttgcgtgttaggaatagaaattttgatgtcatccacacttttatcgctttggcgataatcgatcaattcagcttctgatggtaatttttctgtggtcggttgaggaattggtgtatgcccattttccacataggtatttggcgaaatattgtttggctgtaccatttcttcttgcgtatgggatctagatgttagagaagtgcggtcaaatttattggctttatcaaaatattttgatttctcacgacgatttgaccataatccgtgtacgattaaggcgacaagtgccacgatacccacaataatcaaaattgtatttaaatccatttttattccttacgcgcgatagttcggcgagagtgctataaatggtgctaatgctaccatatttcagtaggtgaaaaaatacttcaaagtgtggaattttaaaggaaaagtgcggtctgttttaagcatatttttattgaaaggaaagaaaaatgttgaatcttaatgaattaaaatctggtttccattattttgtgatgggttggcatttcatcacacaaaaaggtttgcgtcggtttgttattatgccaattgtgctcaatactgttttgctttgtggtttattttggctttttattagccaaatcagcagtgctattgattgggtgatgaattttattccagattggcttagttttctcagtgtcattttactgatactttcgattttaacgattttattgctcttttattttaccttcaccacaatttctggctttatcgcagccccctttaatggtttgttggcggaaaaagtagaaaaaatgctgacgggggaaaatattaatgatgatggtctcgtggatataatgagggatgtgcctcgtatgcttgctcgagagtggcaaaaattacgttatagcctacccaaaattatcgccttatttttactgagttttattcctttggttgggcaaaccatcgtgccagtacttactttcttgttcacttgttggatgatggcaattcaatattgtgattatccttttgataatcacaaagtctcttttgatatcatgaaaaatgtgcttggcaatcaacgaactcaaagtttaacttttggtggattggttacttgttgcacatttgtgccagtgattaatttattaattatgcctgttgcagtatgtggtgcgacgctgatgtgggtggaaaattatcgtaatgacttaggttttaatatgaataaatctttttcctctcaaacagggcttgatgttcgttcagaaaatacagggattgttaaatagcctacagttataaatagatcaaataactatttttttaatcaaaagtgcggtactataaataaaccaacattaacgaagtccaacgaaaggaaaatattatggcaatttatgcagacaattcttattctatcggaaatacgccgcttgtgcgtttaaaacactttggccataacggtaatgtggtggtaaaaattgaaggtcgtaacccaagctacagcgtaaaatgccgtattggggcgaatatggtgtggcaagcagaaaaagatggcacgctcacaaaagggaaagagattgtagatgcaacgagtggtaacacgggcattgctttggcttatgttgcggcggctagaggttataaaatcacgctcactatgccagaaacaatgagtcttgaaagaaaacgcttattgtgcggattgggtgtaaatttagtgcttaccgaaggcgcaaaaggaatgaaaggtgctattgcgaaagcagaagaaattgttgcttctgatccaagccgctatgtcatgcttaaacaatttgaaaatccagccaacccacaaattcatcgagaaacaacagggcctgaaatttggaaagatacggatggcaaagtcgatgttgttgttgctggcgtaggaacaggtggttcgattacgggcatttctcgcgcgattaaattagattttggtaaacaaatcacttctgttgccgttgagccagtggaatctccggtcattagtcaaactttagcgggtgaagaagtaaaaccaggcccacacaaaattcaaggtatcggtgcgggtttcattcccaaaaatttagatttatctattattgatcgcgtagaaactgttgatagtgataccgcacttgccacagctcgtcgcttaatggcggaagaaggaattcttgcaggtatttcatctggtgcagctgtcgcggctgcagatcgcttagctaaattaccagaatttgctgataaactcattgttgttattttgccttcagcgtctgaacgctacttaagcacagcactgtttgaagggattgagggataaataaaaaagaaaaaagtgcggtgaatttttaccgcacttttattaagactagagtagttcaatctgaatgacatcatattggtaagaattatagcgaactagattgcaaggttggttcgcaaattacagtaagaataaatttaggaactgtacaagataaccagaacaaacttcccttaactaattgttttaaaattgaaatttgagattttatttcactgttgttaaaacgtcattcacattcctttaaatgtagctcccaatgctctttgggaatacgtattaaacttgcgtaaatagcgttttgctttattccaaaaatgctcaattccgtttatgttcttgacgttggcaagcgtgaacacgctgaagtttacactgctgcaagcgatagattaaattaatctatattaatgatattagttgttattaatcacaaattaatttacatagcaccctatctttgataccagtgagaataaacaattatgactaaaccccagtaaaatcaaggcataagcgttaaaatttgttgttcttgctcactagcatcctaatttaatccccttattttatcctttccttcttattcaaaatcaattttttcttcttttcatattctgttcattgaatttttttattaatgcagtaaactagccaccgatttttaatcatctttcttttcactttaaatgttacccgcgagtaacaaaaggacacatcatgacaaacaaagtaaacagttatggctggaaagccttaattggctctgccgtcggctatggaatggacggtttcgatcttctcattttaggtttcatgcttagtgcaatttccgcagacttaaatctaacacccgcccaaggtggctctctcgtaacttggactctgattggtgccgtatttggcggcattttatttggtgcattaagcgataaatacggtcgtgtacgcgtactgacttggactattctnctttttgcggtgtttactggtttatgtgcgattgcacaaggttattgggatttactgatttatcgcacaattgctggcattggcttaggcggtgaatttggaattgggatggctctagcagcggaagcatggcccgcacgccacagagctaaagcagcatcttatgttgcattaggttggcaagtcggtgtgttaggtgcagcattgcttacaccattattgctcccacatattggctggcgtggaatgttcttagtgggtatcttccctgcatttgtcgcttggttcttacgttctcatctgcacgaacctgaaattttcacgcaaaaacaaaccgcactttcaacgcaatccagctttactgataaattacgttcatttcagcttctgattaaagacaaagccacgagcaaaattagccttggtatcgtcgtactcacttctgtacaaaacttcggttattacggcattatgatttggttacctaatttcttatcaaaacaacttggattcagtttaactaaatctgggctttggacagccgttaccgtctgcggcatgatggctggaatttggattttcggacaactcgccgaccgcatcggacgcaaaccaagtttcttacttttccaattaggcgcagtgataagtattgtggtttactcacaacttaccgatcctgacatcatgcttcttgctggggcatttttaggtatgtttgtgaacggaatgctgggcggttacggtgcattgatggcggaagcctacccaacagaagctcgagcaacggcacaaaacgtacttttcaatattggtcgtgccgtagggggatttggacctgtagttgtgggctcagttgtacttgcttactctttccaaactgccatcgctctacttgcgattatctacgtaattgatatgttagcgacaattttcttaatccctgaattaaaaggtaaagccttagactaagaaaatataaaagataaaaatgttcgccaagtgcgagcattttttatgaaacaagtcatcttataagtaatatctttataagttttcttttcactaagcaaactttcattattttgccaacagttcgttcaatttttctaatgccatttctggcgtaatatcaatcaaactttgatgatacccaccctctttgtcgcctttacggactttaattaattcaccttcaattaaacgaataatcgttgctttatctgaaagcggcggcgtatattgtgggctagttggtccataaagtgcaatcaatggacgatttactgctgccgcaatatgcattaaaccactgtcattggtcacgactgccgtacaatttgcaattaaatccaccgcttcattcaagttggtttttcctgctaaattgacacaaaactcacgcaactcttctggcagcgcttgacgaatttcttcgcccacaggttcatctttagcagaaccaaatagcgccacagcatagccttgggtaattaacatttctgctaattttgcataatgataatgtggccaacgttttgctgggccaaattccgcaccaggacaaaaaccaataattggacgctcgcctaaaagtgcggtttgtttttcaaatttttttaaggtttcagcttgttgcgctggctcaaccgtcaaatagggtttcaagacaggaatatcatcagcttttggtataacatctttttcaaaagctaatgcaacataacgctgcaccatcattggataatcttttttattggctcgtaaatcattcaataaaatataacggctttcgcctttccaaccgcgacgatggacaatttttgcgaagaaaggaataaacgccgatttcaatgaattaggcaaaacaattgccatatcatattgttcacgcaaagactttcctaaacgataacgcgttcccaattcaaaggccccgtgccctaatggcatttcaatcgccttacgcacctctggcattcgcgcaagcaaaggcttacaccaattcggtgccatcacatcaatattgcagtttggatattgaattttcagttgctggtacaagctgtgcgacatcatcatatcgccaacccaagatgggccaataattagaatattcattttctgtctttcagataaaagtgcggtcaaaaatacttgttattatggcacagagttgaataaaaatatgctcctttaacaatttagtcgaaactctttaggagtcatttcaaattctttcttaaaaacagaataaaaatattgaattgatggatagccgcaaatctcagtaatttctttaatagaaatatctgtttgttgtaataaattctttgctcgggaaattttttcttcgtggatgacttggtgaattgttttattcatttcattcttaaaacgttgttcaagattagaacgtgaggtttcaagatgatctaaaacttgtcctactttaattcgatgacaggcacgatgacgaatataatgcattgcttgaatgacaagcggatctgttaatgatcgataatctgtagaatttcgagagtgaacggtaatcggtggaattaaaataggggtatgtgaaactttttgaccattgagtaatttgtgtaataatttcgcagcttgataaccaatctctctcgtgccttgttctacggaggaaagggacatacgcgataaatattggatcaattcttcattatcaataccaaccacacaaagctcttcaggtacagcaattttactgtactcacaagcctgcaataaatgacgagcacgcgcatccgtaacagcaataataccagtatgagaaggaagagattttaaccagacaattagcttttgttgctcttccaaccaattttgagcatgaacctgcacaccctcatataggtaaatagggtaatgatttttctccatcaactctacaaaagcatctcttcgttctatagaccaatgcttatgagtatttacttgcaaaccataaaatgcaaactgtgacagtcctttctcctgtaaatgagataaagccatttcaaccaatgccatattatctgttgctatataaggaaagtgcggataaaaatcagcttgtttataagatccaccaactgctatagtaggaataagagtgtgttgcaataattcaacagtttttggatcatcaaagtctgcaataatgccatcaatagaaagttgattaatggtatcagtatgatagataaattcatcttctacaaaaatatcccacatacattgcgatgcctgaatatattgtccaataccctccaccacctgccgatcatatactttgtttgcattaaataagagggcaattttgtagtattgttccgtcattttatatccttatctatgggaaattgctatttaagttataatagaaaagatatttagcttcaagataaaaatagccagaataactggccatttttatatccaataccacatttatttttttagcttcgcaatacctattccacttgcaccataaataatagcaaagataataccgctccaacataaaattgcccaaggtaaataagacaatgttgcaacacctaatgtgcctgccatatatgcacctgcggcagtccatggcaaaataggttcaataattgttgcggagtcttctgctgttcgacttagattttttggatgtaatcctttttctacatacgcatttttaagcatttctcctggaattagaatagaaatttgcccattacaagtaaccccaatcattgttagaccgcaaagaatcgttgtaataatcaaagaaagagttgaatgaacaaaggtgagtaatttttgaataatcacggttaatgcaccgctcaattgtaatacacctgcaaatgacaatgcacagaaacaaattaatagtgttcccatcattgagttcattccaccacgattcaacaaacgacttaaatcagagctaactgaagtatggtgaatcattgaggtatcaaatccattaactgcactattaatcacatcagatagagagaatttttgaattaagatagcattaataattgcgataaatgctgataataacatcactggaatagtcggtttcttagtaatagatccccataatacaatagcgactggaataagtaatagaaagttaaaatgataaacttgctctaactcatgaatcattgtatttactttttctggagtcgctacattagaaaaatcgtagtttaaaccatataccacatagacagtagccgaaagaataaaagatggtaatgttgtataaagtaagtgagcgatatgctcatataaatctacgccagcagctgcggatgcaatattggttgtatcagataatggcgataatttatctccaaaatacgcaccagcgaccacagcacctgccgtagcagccaaattggcgtctaatccaatcgcaactcccataaatgccacaccaacagtccctgctgacccccaagaggttccagtacaaatggaaacaatagcagtaaggaataaggctgtcacataaagatattctggtgatatcgcttttagtccgtagtagatcatcataggaattgttcctccactaatccaagttccaattaataatcctacagtaattaaaattaatagcgcaggcattgttttagctattttttctgaaatggcatctaaaatatctaaatagcaatgacctaatttaaaaactaaaaaaccagcaaataccgttgaaataatcattaatggctctgctggcaaatcaaataaagcatacccaagccctaacagtaatagcatcacaatgattggtgaaaaagcttctaatgttgttggcattcttgtgcgatgagtggttttcatattaaatctccctattgtttaataaacaaaacccatttttgattcgattcaatgcttctaataatttttttctaggcatagcgacattcatacgaaagaaaccatctccctctttgccaaattcactccccaaagatacttttactcttgataaattattaatccaataagctaattcattttcatttatacttagctttttatagtttatccaaagtaaataagttccatcactttcagtaatatctaataatggaatatactcattgaaaaattcttttactatcttcttattattctttatgtattcttttagatagattacccaatcagtacaatatttatataacgaaataatagctggtatagagaaataatttggattatgtatacctaatgccatcatttattttataaattgttctcgaatttctttattctcaataattaggttagctatttccaatccaggaatattaaaagtttttgctggggataaacagatcattgagtgatttgctacccattcatctaatgatgatattaaatagtgggagtcatttgttagtgtaaagtctgcgtggacatcatcggaaatgataaatatattatgttttttagctaagtttataattttaataaggacttctttattccaaatcgttccagttggattatgaggagaaattaaaacaaatactttagaatgtttaaaacattcctctaataaatgaaaatcaatatgatactttctattttcataaaccaaaggacattgatataattttctgtcatttaattttatcgtgtttaatattggactatatgaaggtgatagaatacatattccatcagtttcttttgtaaatgctcgtatataaatagatacggcttggattattcttgggcaaaatacaattttttcagagagaacagaataatgatattgttcgaaaatataatcactgattatcttgtaatagtcggctggtaattcagtataaccataaattcctaaacgattaaatttttctaattcatctatcattatctgaggggctggaatatccatatccgcaacagacattggaataatatcattatctacattccatttagcactaaatgtatttaggcgatcaataatcacatcaaaattataaaaattattcattattcctcctgatgtataaggcaaatttactttagtcaaagaagaaaagaattaaaattactaaaactactttatctattacgttttttcacaactgtgatctagtccacaattgtaaataatcactataaaaaattaaataatgtaacggataagaacttgtttttttataaaaagatgaaaaatttcatcatctagaaagcagtatgttaggtaaccatttctataaaattaaaaaaccgccattttataaatgacggtttaaaattaataattacatctttttcttattactagtatctatccatacagcaagtaacaaaatgccacctttgacaatatattgccaaaaagttggcacatcaagcatactcataccattatcaagcgatgcgatgataagtgcgccaataacgaccccaaacacacttcctacaccaccagctaagcttgcccctccaatgacacaagctgcaatcgcatctagttctgcattttgcccagcagatggtgatcctgcacctaaacgagcacttaaaatcaaccctgctattgcaactaacacaccattcattgcaaagataatcagttttgttttctctacattgataccagataattttgccgcatcaatattgccaccaattgcataaacgtggcggccgaatgaagttttacgagagaggaataaccctaagattgcaagaactgccagtactaaaacaggaaatggaatgccacgataatcattaagtaaataaattgctcctaatacaattactgcaaacaaagcatatttcgtaaaatcttttgataatgcagacacttccagctgaagctgctggcgacttctacgttgataatttccccaaagaacaaatccaataactgcaataccacctaagataacccctgcaatatctgataaataaccttgcccaataactgtcatagttccactaataggagatacagttgtaccattagtcaaaccaatcaaaattccacgaaatgcgagataacctgcaagtgtaacaatgaaggatggcactttgcgataagccacccaccaaccattccaaataccaaaaattaaaccaagagcaattgttgcaataatagttacaggtaatgggaagccccaccaaacatcggcaatagctgcaaatccgcccagtaggcccataagtgaaccaacagataagtcaatttcagcagaaataatgacaaaaaccattccaattgcaagawtgccagtaattgargtttggcgtaacaagttagaaatatttcttgcacttaaataagcgccatcagtagcaacactaaagaatgccataatgactgcaatagctattaacataatgtaaacttgtaaatttacggattttaacttaaacatagattactccttaagtgctgtttccataacttgttcttgagtaagagcagtattgataagactagctttaagtttaccttggtgcataacaagaactctatcactaatgcctaaaacttctggtagttctgatgaaatgacaataatagcaatcccttcttgtgctaattggttaattaacttataaatttcatatttcgcaccaacatcaattcctcttgttggttcatctaaaatcagtattttaggatttaacgataaacattttgctaggatcgctttctgttgattaccgccactaagtcgtcctattggcaaatctggtgaaaaagttttcacctttagtcgtttgatggctgagccaattatttgctcttcttttgcttcattaactaccatttttccgaaacaataagatttcaaagaagaaagcgtaatgtttttgccaactcccataatagaaacaatgccgtgtttcttccgatcttcaggaaccatcacaattttatgttcaatcgcttgggcacaatttttgatatttacttgtttttgattgataaaaatatttccttcaaacttaccttcataagacccaaataagcattgcaccatgtctgtacgacctgaaccaactaaacctgcaacacctaaaatttccccctcatgaagactaaaacttacgttatcaacacgcttaatatgtgtattgattggatgccaagcagagagattttctactcgtaaaatttcatctttgatttcatgaggttcatgtggataaagtgaggtaatttcccgacctaccatcatggtgataatgtcatcttctgtcattgttgaagcgtctttcgtaccaacatgttcaccatcacgaatgacgcaaattttgtcagagatagccttaacttcattgagtttatgggaaatatagatacaagcgatattgtgtgctttaagatccttaataagatttaacaaaatttccgtttctttttcagtaagtgaagccgttggttcatctaagataagaagtcttacttgtttattcaaagccttagctatttcaactaattgctgttgccctaaacctaattctcctactcgtgtattgggatcggcatctaattgcacctgctgtaataaatttttgcaacgtaagtacatttcattatctgctgtcaaacctttatgagttatttcgttacccaaaaaaatattctccaatacagacatattctttacgagagtaagttcttgatgaataattgaaatgcctttttcttcagtatctctaatattccttgcttttagttcactttctgaaaagtaaatatcaccgctgtaatctccacaaggataaataccgcaaagtattttcattaatgtagattttccagatccattttcaccacataaagataaaatttcccccgcttctaattcaatggatatattatgaagtgcggtcacatcaccaaatttttttgtgatatgtttcatttccaacaatgccatatcgtaactccctaagaggtaagggaagagttttctcttccctcttaaagttagtgataaatactttccttagtatgaaaaccatctttaattacagtttcattaatattacgtttatcaacagcgataggatcaagtaaatacgcaggaacattttttaagccattattcagttctgcattagcttctattttttcattcttacctaattcaaccgcaatttctgccgctttatctgcaagtttcgtaattggtttataaacagtcatagtttgcgagccattgacaatacgtttaattgcagctaaatctgcatcttgcccagaaattgcgactttcccagataagccttgtgcgctaagggcttgaatcgcacctccagcagtagcatcgttagatgcaacaacagcatccacattatttttattagctgttaatgcgttttccataatttgtaacgctttttcagctaaccaagaatcaacccattgatctcctacaaccttaattttcccactggcaattaaaggatctaatactttcatttgcccttttctaaataatttcgcattattatctacaggagatccccccattaaaaaataattaccttctggttttacagccacaatacttttagcttgtagttcacccactttttcattatcaaaggaaacataaaaatctaaatctgcattattgattaaacggtcatacgctaatacttttattccttcctttttagcttcagaaataacgttacttaatacttcaccgttatgaggaataattactaatacatcaatatttttattgatcatattttcgatttgagaaatttgtgctgaatcatcaccatttgcagattggacaaacacttttgcacccattgattctgctttgtttacgaaaatatctcgatctttttgccatctttctaaacgtaaatcatcaatggataaaccaattttaagatctttggaatgggcagaactactaaatacagttaatgcaccaacaagggtaagtaaagctgatttgattttcatattgatacctcaatagttaagtgaaggactagttattgctccagttgttagttttcacactttaaaaaaggctttcaattataaaatctttctccattattacgttttttcacaactgtgatccacgccacagttgcaaataatcaacatagaaaaattaaataacataattgatgaaaagttagtttttcacaaaaatacgaaaaatttcatcacctagagaggaaaatgttatgacaacctatttcgataaaattgaaaaaatctcctttgagggagaaaaatccacaaatccttttgctttcaaacattatgatgctaatcaagtaattttaggtaaaactatggctgaacatttacgcttagcggtgtgttattggcataccttttgctggaatgggaatgatatgtttgggctaggttctttggaacgaagttggcagaaaaattcaaatttgcttgctggcgcagaacaaaaagccgatattgcttttgagtttttgaataagttaggcgtgccttattattgttttcatgatgtcgatattgcacctgaaggtaattcagtgcgggaatatgtacaaaattttcatcatattgttgatattttagaacgcaaacaagtagaaacgggtgtaaaactcttatggggaactgcaaattgttttactaatcctcgttatatgtctggtgcagcaaccaatcctaatcctgaggtttttgcttgggctgcaacacaagtgtttaatgcgatgaatgccactcaacgtttaggtggagaaaattacgtattatggggtggacgtgagggatatgaaactttattgaataccgatttgaaacgtgaacgtgaacaaattggtcgttttatgcaaatggtggtagaacataagcataaaattgggtttaaaggtacattattaattgagccaaaaccgcaagaaccaactaaacatcaatatgattatgatgtggcaacagtgtatggtttcctaaaacaatttggtttagaaaaagaaattaaagttaatattgaagctaaccacgcgacgcttgctggccatacctttcaacatgaaattgcaacagcttgtgcattagatatttttggctcaattgatgctaatcgtggcgatccacaattaggctgggataccgaccaattcccaaatagtgttgaagaaaacacgttagttatgtatgaaattttaaaacatggtggttttactactggaggttttaattttgatgcgaaaattcgccgacaaagtattgatccttatgatttattttacgctcatatcggtgcaattgatgtattggcattatccttaaaacgtgcagcaaaaatgttacaagaggaaaccttacaaaaaattgttaatgaacgctatgcaggttggaatagtgaacttggtcagcatattttgcaaggcaaaacttcacttgaaacacttgcgcaacttgtccaacaaaaagatttagcaccaaaaccagtttcaggtcagcaagaatatttggaaaatttggtaaaccaagttatttatagctaaaaatgaagcaaaagtgcggttgtattccaccgcacttttttattttaggagacattatgtatataggaattgattgtggcacacaaggaacaaaggcgatagtgcttgattctgtccaaaaaaaagtgattggagttggttacgcaaaacatgaattaattacacaatccaatggaagacgtgaacaacaaccaaattggtggattgaggcattacaacaagcattacaaattgcattgaaacaagcaaaaaattcaccgcacttttcacctaatttagtgaagggaataggcatttcaggacaacaacatggactggtaatgttagataaaaacgatcgtcctctatataaggctaagctttggtgtgatacagaaaccgctacggaaaatgatatactgatcgaaaaattaggcggacaaacagccgtatttgaaaaattaggcatcatttgccaaactggttacacagcttcaaaactaagttggtttcgtcaaaattatcctgacaaatttgccaatattcgcaaaatcatgctgccacacgattatctaaattattggctaacaggaaaattctgcactgaatttggtgatgcttctggtagtggttatttcgatgttgtgaaaagagaatggaaaagagaagtcttcaaatatcttgctccagaattaaatatggatgaagtgttaccaaaattactttctgctgaacaaaaaatcggtgtgattaaacctgaaattgcgactttatttggttttaatgagaatgtcatcgtctccacaggtggaggcgataatatgatgggagcaattggtacaggaaatattcgagaagggattgctacgatgagtctcggtacttctggtaccttgtatgcttatacgcaaaagccattacttaatttaccaccaatgatcgcaaatttttgttcaagtaataatggctggttaccactggtttgtgtaatgaatataacctcctcaaataaacagctaatgaatttgctcaatattgatattgaagaattaaatcaacttgctcaacaagcacctattggcgcgaatggcatcactattttgccattctttaatggtgaaagagttccacctttacccaatacaaaagcgagcattttaggattagattcaagtaatttcacacgagaaaatctttgtcgagcaatgatggaaagtgctacttttacgcttcgctatggcttagatttatttcgtcaagctggcctcaaaacctcacaaattcgcctaattggaggtggcgcgaaaagctcattttggcggcaaatgattgctgatgtgatgaattctgaagtggtatgtttgcaggaagaagaagctgctgcattaggaggagcaattcaagctatgtgggcaaatggagaaggagaactggaatttttatgcgaaaccttcattcacttagatgaaaactcaaaagcttatcccaacttatcacaggtgaaaaattatcaaaatgcttatgagcgttatttaacacatttatcacaattatattaaataaaatcccctataccgataagctataggggatttactacattaataatttattttctattcaaccacgccatatattcagtcacgccttccgcaactgttttgaatggtttatcgtagcctgttgagcgaagtttagttaaatctgcttgagtatattcttgataacgagatttcaaatgctctgggaatggaatggtttcaatctcgccttttccgtggaatttcactaccgcatcagccaccgcacggaaactttctgcatttcctgtaccaaggttgtaaatacccgaaataccattttgccaacaccaaatattcactgctgccacatcacccacataaacaaaatcacggcggaagtgttcgctgcctgcaaataattttggattttcgccttttaagatttggttattcaagtggaatgccacactcgccattgaacctttatgattttcacgcggcccgtaaacattgaaataacggaaaccacatactggcgattttgcttctggcaaaatgttacgcacatattgatcgaacaagaatttagaatagccatacacatttaatgggccttcaaattcacgttcttcacggaatactttggtatctccataagttgctgcgcttgaggcatagraaaaaggaatttcgcggtcaaggcaataatgcaacaactctttagaatattcgtagttgttgtgcataatgtatttgccatcccattccgtagtcgcagaacaagccccctcgtggaataccgcatcaatatcgccaaattcatcgcccgcgataatagaagcaatgaaatcttctttatcacaataatctgcgatgtctaaatcaactaaatttgcaaatttcgtgccatcttttaagttatcgaccactaaaatatctttgcgtcctaaatcattcaatgctttgacaatattgctgccaataaaaccagcgccacctgttacgataatcataattctgtcctctttaaaataagtctgcgtattgtaatagattttctaccgcttagccaaaaaactctgcgaaaaacaaccgcacttttaatccccaataactcgtaaggccggtcgtaacaagatccattttgcctttactcaacaacacaattgtgggtgtcacattaatttgccatcgttctgcaaattcccctttaggatcattaaccgtagtgaagtggtagtcatttttacttaaataatcatttacgtctgcctcattacctgaacgtaatgccaccgatacaacttgatacccttcttttgctaaagaattaattgctggcgaagtataacgacaataaccacaccaagttccccaaaaataaagtaatgtgggtttgttttgatcaagactttcaagagagaacgtattcccttgaagatcttgtaacgtgattttatttatttcctctggcactacagggcgacgaacaaaatccagtatgctagttatcacaataaaagttaaaaagagggataatccattcttgagtaattttttaatcttcattttatttattccttatcttgttgagatgattgtaattgagcgtaaaaccatagtcaaaaataaagaatttttgctacaataggtaaaacataaataaaaggaggaaaataatgacatcaaatcaacttgctcaatatatcgatcacaccgcacttaccgcagaaaaaaatgaacaagatatttcgacactctgtaatgaagcgattgaacacggattttattctgtatgtatcaattctgcttatattccactcgctaaagaaaaacttgctggctcaaatgtaaaaatttgcaccgtagttggattccctttgggggcgaatttaacctcagtcaaagcatttgaaacgcaagaatctattaaagcgggtgcaaatgaaattgatatggtgattaatgtaggttggataaaatcgcaaaaatgggatgaagtaaaacaagatattcaagcggtatttaatgcttgtaatggcacgccattaaaagtgattttagaaacttgtttgctcactaaagatgaaatagtgaaagcctgcgaaatttgtaaagaaatcggtgtagcttttgttaaaacatcaacaggctttaataaaggtggtgcgaccgtagaagatgttgcattgatgaaaaacacggtcggcaatattggtgttaaagcatcaggtggtgtgcgtgatactgaaactgcacttgcaatgattaaggcgggtgcsactcgcattggtgcaagcgctggcattgcgattattagcggtactcaagacactcaaagcacttactaatcctttcacgcgtggtattctttccacgcgtttttacatattcgacaatttctgcagcaaacgaaccattgctcgatagcccaaggcctccgccaagtgcggttgaaaaatttgttgttctccttgtagatcggcaatggttcgagaaactttcaaaatacgatgataagcccgaacagaaagccccagtttattcagtgctttttcaaggaaaaaggcatctttatcatttaacttgcaatcacgctcaatctctttactgttcaaataagcgttgattttccccgctctttccatttgaatctcacgtacttttaacactttttcacgaacttgcgcgctggtttcgccacgatcgcccgtattttgcaagctaccttgtggcagtaaaggcacttcaatagataaatcaaaacgatctaaaaatggccctgaaagtcgattcaaataacgcataatttgctgtggtgaagtgcggttatgtgttcctgtataatggcctgtcggacttggattcattgctgccactaattgaaaacgagccggaaattgaattttggcattagcacgagaaataataatctcaccactttccaaaggctgacgtagtgcatctaacacttttcgctcaaattctggaagttcatcaagaaaaagtaccccatttgttgctaaggatatttcgccaggtttagggatcgttccgccaccaactaaagcaggcattgatgcactatgatgtggtgcacgaaaaggacgttgcttccaattatgaaaatttaactcgttttgaactaaactcgttacagatgccgtttctatcgcttctaaatctgtcatttcaggtaaaagccctgtcaaacggctggctaacatggttttccctgtacccggtgggccaagaaagagcaaattatgctgccccgctgcggcaatggtcaatgctcgtttagcgtgctgttgtccgataatatccgttaaatctaacgtatttttacctgaaaaatttaccgcactttctttcacaatttcagtggcgagtggtaatttttcctgaccattgagaaattgcactacatctaaaagcgtttgagcaaaataagtattttgatcagacacgagcgaggcttcattagcattttgtttcgcaataattaactctcgctttgacttttgcgctgcaagaatagcgggaatcacaccatgtacgccacgcaattggcccgtcagcgcaagctctgccacaaattcaaattgctttaagtggctcgcatcaagctgatctgatgcggctaaaattccgatggcgataggcaaatcaaatcttccgccttctttcggtaaatccgcagtgcaagatttacagtgatacgcttggctgggtatttaaattgtgcattcatcaacgcactacgcaccctatcttgtgcctctttcacggttttttctggcaaaccaacaagtgtaaatcctggttttccgttgcttaaatgcacctcaatggtgacaagcggcgcttgcacgcccatagaggcacggctgtaaacaatagcaagggacatgataatccttaaagtgcggtaaaaatgaagatagtttttgcactataaaaaaagcacgtaatgaaatcattcattccgtgctttttttgcgatctagatcgcaaaattcatattttwattccgcaaaaagtggcgaaaaccaaaaatctaatttcaccgccaatttatcaataccaattttattttgtgcagaaaaagcctcaacttgtatatcgccttgaaatggaagaattgcttcacgcaccatttttacttgtttactacgtgcgctttggctcaatttatcggctttagtaagcaataaaagtaccggtaaatttgctgaaaccgcccattcaatcatttgttggtcaagatccttaagcggatggcgaatatccatcaacacaaccaatcctgccaaacattctcgtttttgcaaatattcgcccaaggatttttgccattggattttcatttgctctggcacggcggcatagccatagcctggtaaatccaccaatttacaattaggctctacttcaaataagttaatcaattgcgtgcgccccggtgtttttgaggtgcgcgctaaatttttttgattggttagtgcattaagtgcggtcgattttcctgcatttgaacgacccgcaaacgcaatttcaatgcccgtatcttcaggaatggaacgaatattcggcgcgctcgttaaaaagtgggttttgtggtaattaagtttaatttcagacataagtattccttttaaaaattgtgtttagaatagcataaatggaaaatttcctgaaattatgtcaaaattctctctgaaattataatcaattaatggcaatccagatgacaacaaaaacaacttaccaatggcctcaatctaaggatatttatccatatcgaccagggcgttttgatgcaccaaaacattggcgttataacttacgtagctttttaaatcgtggttcaattcgtcgctttgaacaatttatcaatcagcatccttttctcatcgatatttttaatacgcacttggattatagttatcctgttgcttgtcgttttttagataagcgttttaacgcatcacagcgttttcatgcggtttgtgagaatcttttatttttacccgaaaaacttaccgcactttctacgccgttatgggaaaaacctctaagttttggcgaagtcattcctgattttgaaatgacattaagcatgacaacccatcaaccgatggaaggatattgggtattggagctatggcataaaccaagaaacgaattagtctatttgcttacttttgccaaattgggcgatgcgttgcttattgctgttgtacaagggccaaattttgaaggctcaaaggaaatggtgaaacaactaaccaaattatgccacggtttacgccctgcctatttaatggttgaaaccatgaaatcactcacaaaaatactaggctacaataaattgctgggcattccacaaaaataccaaaataaatctcgtttcatccaaagcaaacaatatacagtggactatgatgcaatttttggcgaatcaggcggagaattaaaagattactgggaattgcctttagaaatggatagaaatctagatgatattccaagtaaaaaacgttccatgtatcgtaagcgttatgcgatgctagatgatttggctaaggtaattgaagaaaagttaggattgtaaaagtaaaaagtgcggtgaattttaaccgcactttttgttttataagactttcaagcaagccacaaaatggctgttgttttggctggtgaaaggtggtttttgtttcgcacaattctcatcagcctttagacagcgagtacgaaatacgcaaccagacggtggattaattggcgaaggcaaatcaccttcaagtaattcgatggatttattgcgttccaattttggatcggggatcggaacagcagacattaaggctttggtataaggatgtttggtatcgttatatacttccacatcgctgcctaattccattgcattgcctaaatacatcactaatacgcggtcagaaatatgttttaccaccgctaaatcatgggcgataaaaattaaggaaagccccatttctttttgcagggatttcaataaattcaccacttgagcctgaatcgacacatctaacgctgaaacgggctcatcacaaatgatcattttgggctcaatgattaacgcacgagcaataccgatacgctgacattgaccaccagaaaattcatgtgggtagcggttaatcaagttcggtaaaagcccaactttcaacatcatagcttgcactttttctttcacttcggcggcacttaagtgcggttggtagatctttaatggctcagcaatgatttcgccaatattcattcgcggattgagagaggctagtgggtcttggaaaatcatttgaatatctttacgcgtttctttccattgtttcgctgattgttttcgtaaatgtttaccaagccacaagatttccccttcactcgcttcgactaaaccgataatagcgcgtgcaagtgtggatttaccgcaaccagattcacctactacgccgagagtttcacctgcgtaaagtttaaaagacacatccttcaccgcttttaaggtttgcggtttggcgaagaaaagggatttatcatttttaattttaaaactgacgcctaagtgattgacttcaaggagtaattctttgttgtttgagactgtcataggttaaatttctccgctgataaccaacaattacgtaattgaccgtgattaaatgtagtcagttttggcgcaatttggcattgttcggtagcaaattggcaacgaggtgagaatggacaaccttttggcaaatgcaataaattcggtggattgccaggaatggttaccaagtgttcttcattgccgtctaagcgaggaatcgcatccattaagcctatggaatagggatgggttggatgatagaaaatttgttccgctgtgccgtattccatggttcgtccagcatacatcaccatgacttgatcgcagataccagccactaccccaagatcatgggtaatcataataattgcagtattaaattcacgttttagttcatttaataaagtcatgatttgtgcttgaacggtcacatccaaagcggttgttggttcatctgcaatgagtagtttgggacggcataataaggccatcgcaatcatcacccgttgacgcataccgccagaaaactcgtgcggatacatgcccatgcgttttttagcttctggcattttaactgcgtctaacattttcacggattcagcaaaggcagtttgtttatcatagcccttgtgcaattgcagcacttccatgagttgttcaccgattttcatgtatgggttgagtgacgtcattggatcttggaaaatcatggaaatttgctcggcgcggattttattcaattcagcattcggtaaattaactaattctttaccttcaaaaatggcagagccttccacttcaccgttggctgccaataaacccattaaagcaaaggctgtttgtgacttgcctgatccactttcgcctacgatgcccagcgtgcttcctgcattcagcgtgaagtttaagtcattcactgctgtaacgacgccatctggtgttttgaagcgaacgtagagattttttacatctaataaaggattcattattcgctcctatctatctttcggatcgagcgcatcacgcaacccgtcaccgataaagttaaaacaaaatagggtaaggcaaaggaaaaatgctgggaaaattaataaccaaggcgacacttccatttgtgcagcaccatcacttaagagtgcaccccagctactcatcggttcttgtgtacctaatcctaagaagcttaagaatgattcaaatagaatgagtccaggcacttcaagcgaggcataaactgccactaagcctaatacattcggaataatgtgtttcaaaatgatttgacgacgaggtacgccacaaacgatggcggcttcgacgaattctttattttttaggctgagggtttgtccgcgtacaatacgtgcaagaccaagccaagcaatggccccgatagcgataaaaattaagaaaatgttttggccaaaaagggtcaccaacaaaatcacgaaaaacataaatggaaatgagctaagaatttccaaaaagcgcatcatcagcatatctgttttaccgcctacataaccggaaatcgccccataaattgtgccgatagtgacggaaatgaaagcaccagcaataccgaccaataatgaaatacgtccaccgatagcagtacgtaccaacaagtctcgacctgaggcatcggtaccgaagaagtgatagccttccattgttggtgcggcgctcatcatattccaatcggtatcttcataggtaaatgggaagaaccaaggtgctacggtgataaatataataataaacgccaaaataatcagactggcaacggccgctttgttgcggaaaaaacggcgtttcgcatcttgccataggctgcggccttccagttgcatttcttcaatacggtcagccacttgttccacaaaatccgcatttttctgattaatcggctgagtacgataatctgtcataatttatccttaataacgaatttttggatcgatgatggcgtataaaatatccacaatcgcattaaataaaatggttaatgtccccactaaaatggtgaggctcaaaactaaagagtaatcgcggttcaatgccccgtttacaaataataatcccatgccaggtaaaccaaatacgctttcgatgaccattgagccagtaataatccctacgaaagcaggtcctaaataggttatcacgggtaaaagtgcggggcgcaaagcatgttttaaaatgattctcgacatggaaagtcctttagctttggcggttcgaataaagttggaatgtaacacttcaatcatcgaaccacgcatgatacgcgcaatccctgcaacataagcgatagttaaggaggctacaggtaagatcatgtacatggcggtaccgccgttccaaccgccagctggcagccatcctagataaatggcgaaaattagcactaaaacaggtgcgaagacaaagcttggcataatgaccccaagcatcgagaaactcatcaaaatataatcccaacggctattttgattgagagcggcgagcgtacctgctgttactcctagcacgactgcaaaggcgaaggccaccattcccaattttatggaaacagggaaagctgacgcgattaaatcattgactgattggtctttatatttaaaagagggaccaaaatctcctttggaaagattttctaaataaaggaaatattgtttatataatggttcatttaaatgatacttcgcttcgatattagccatgacttctggcggataagcgcgttcagaagtgaaggggctgccaggggcgagacgcatcaaaaagaaagaaaaagtaatcaaaataaacagcgtcggtaaggcttccaacagccgtttaaaaataaacttgagcataacaactccaaccaaaatgggcgaaaagtgcggtcaaaaaatacgacgatttttaaccgcacttaaatacgagtaacgaattaatgtttaataatataaagattgcgtaagtaaatatgatcttgtggatctttgcctgaataaccttttacgtaaggtttcactaagcgtggattcacatagttaaagattggtacgataccgtaatcttttccaagaatttcttcggctttcgcataagcttttgcacgaccttctgcatccgttgctgcgtaagattctgccatcgctttatcatattctggattcgcatatttcgcggtattgttactagaattagataagaaatagttgccgaatgttgttgcttggttgtaatccgcattccatccagcacgcgccacatcgtaacgacctgcacgacggctatcaatgtaagttttccactcttggttttctaatttcacgtcaatcaaacctttggtgttagctttccacatagatgctgcagcaatagccacttttttgtggttttcattggtattataaagaatgctgaatttcaacggattcgctttactgtaaccagcttcttctaagagtttaatggcttcttcattacgttgtgccatcggttcttttgaataagcaggttgttgaatgagatgaccttcttcgatgtaagttggggtaaacacataggttggtgtttgaccttgacccaatactttatcggtgatcacattacgatcaagggataagttcaaggctttacgaatattcacgttatcaaaaggtgctttcttattgtttaattcataagaataagttcctagggtacgagtaacgtatacttcgcctggcaattctttttgtaatttagcgaattgttctggcggtaaaccataactggtcatgtctaaatcgcccgcacgataacgcgctacatcggtacttgggttttcaatggcgaggaatgtcgcgctattgattacggtttctttatcgttccaataaagtgggttacgttcaaattcgattttttcgttaatgatgtggttagccagcttatacgcaccgttacccacgtagttttcttttttcacccatgcatcacccaatttttcgactactttttntggtaatggcaataaggattggtgagtcgnnaaactgactgtataaggcacaggattggttgtatgaaccacaaaggtgtaatcatcttttgnttccacgcctaattcagccggttttttcttaccgtcaataatgtcttgtgcattttcaacttgtaaattaacttaggtaactcgcgtaaggtgcagcagttgcaggatccactaaacgacgccacgcaaacacgaaatcgtgtgcagtaacaggatctccgtttgaccatttagcatctttacgtaaatggaatgtccaggttttgaagtcaggtgtattttcccagctttcagccgcacccggttgaagtttaccttcagagtctgaggtgactaagccttcaagtaattgataagcaacgttagattctggcacaccttcggttttgtgtgggtcaaaactttgcggttcagccccgttattgatgacgatatgttgtttttcatctaattgtgttccttcaggcactataactgcttgcgcagaataggaaagggcaagagcgattgcagagaagagtagtttgtgttgcatttgagcctccttgtcattaggcgatatttttataaaaagtcttctatttattagctcaaaaattcatttttgtaaagatttgtcaggaaattatttgaagaaaaattgagttttgtgagttgtgtctaataaatcgctaaaaaaattgctaaaagtgatgatatgagaggcgggggatctaggatgtattgatttttcctattgtaaatattttcctacataaattacccttttaatgctaattgtgctatcgtaacctgattagatttaaacaagtccattcaaggagaatacaatgacaacacagttagattcacttcgtaatatgaccgtngtcgtagctgatactggcgatattgatgcaatcaaaaaataccaaccacaagatgcaacaacaaacccatctttaattttaagtgcttcagcattaccacaatacgccccattaattgatgaagcggtanttatgcaaaagcacaaagtcagacaaagcacaacaattaattgatgctgaagataaattagcggtaaacatcggcttagaaattttaaaaattgttccaggacgcatttcaacagaagtagatgctcgcctttcttacgatacccaagcaacggttgaaaaagcgcgtaaattaattgcactttataatgcagcaggcatctcaaatgatcgtattttgattaaaatcgcttccacatggcaaggtatccgagctgcagaaatccttgaaaaagaaggcattaactgtaacttaaccttattattctctgaagcgcaagctcgtgcttgtgcagaagcgggcgtttacttaatttctccatttgtaggtcgtattttagactggtacaaagcaaattcagacaaaaaagaatatgcgccagcagaagawccaggcgttatttctgtcaccaaaatctataattactacaaagaatatggctacaacacagttgtgatgggcgcaagtttccgtaatgtaggtgaaattactgaacttgcaggttgcgatcgtttaaccattgcaccagcattactgaaagaattacaagaaaattcaaccgcacttgtacgcaaattagaatacaaaggcgaagtaaaagcgaaaccacaaccattaacagaagctgagttctactggcaacataacagcgatgctatggctgttgaaaaattagcagagggtattcgtaaatttgctattgaccaagraaaattggaaaccatgctttcagcaaaactttaatccatcattcaatataaaaaataaccgcacttcaatctgctcttgaaatagttaaagaaaatatttaactaatttgggtgcagattttttatttattaagatataaaagtgcggtaaaaattcggtgtatttttgtttatttacncctagcngcaatagataatggttacagaaatattattaagtaatacattttcataacnaaatagatgaaatttattataaaaatattttaataaagataaattatatttttaatttatactaaattagtagttagaattttnacttgcgataatatcagagaaaagtggtagtcttcccaagattttatacattctggaatgattaccatttgatatatgattataaattagcttaataaatcacttaatttcttaattaagataatttttctttcctcaaagaattgatcaaaattatcaatagataagtccacatcaggtataaagatggttgtcgaaaaaagaggttatattagattttgtatttttatttacccattcttcaagagaagcatcttttttcgatgtattttcatcaagccattgtaagttataaatagaattataatttttatcagctttttgagttaatagtaactccttaataaatttatcattgatagattaatttaccatccagcttgtgactgcgataaaaattgcaaagatgcaaaaccaaattatgtggagttttgtgcttttacgattgacttcttcattatgtaagcgtcgagcttctaatctttgtttgtacatctctagatctttttgtttgaaagagaagccgcaattagggcaattttctgcattttcactaatcttttttctgcattcagggcatcttgttaaggacatatttgcttttatacctattcaattacttatttattagcattttaatggatgttttagattttacaaatgtgatacaagtcacaaatcttataaaaatctttaaattcaattttgatttgacgtaatttgaaatagaatacagccgcttgtttagggcatataaatacttttactttattttttgaggagccttcctatgttatggtttttcttttgtgtaaccgtgttgattatcggttactttatttatggaaaaattatcgaaaaaatttttgtgattaatccaaaacgtcaaacacctgcttaccaagtaaatgatggtgtggactatatgccaatgtctaaaacgaaaatttggctaattcaattgttaaatattgcgggaacaggccctatttttggccctattcttggtgcattatatggacctgtagcaatgctttggattgtnattggttgtatttttgctggcgcagtacacgattatttctgtggtatgttaagtattcgtcacggtggcgcaacaatgccatatttggcgggtaagtttttaggtcgtcccgttaaagtctttatcaatacattagcacttgtgttgcttttacttgtcggtgttgtgtttgtggcaagcccagctcaattaatgggtaccattacaatggatgtatttggtgtttcgcaaggtgcgttagtgcttggtgatgcagaggcagttcatcattctgttgaagctggtgggattaaagtatggggaatggataaagcaacagtggttgctgtgtggacagcaattatttttgcttattatattcttgcaaccttacttccagttgataagattattggtcgaatttatccactctttggtgcgttattactctttatgtcagttggtatggtatacggattagttgtttcacattttagtgcaacagatccaattgagtttttccgtacaatcaatgctgatggcgagggtttaacttgggcgaaatttacacaaaatttccaagtgaaaggtgatgttccaatttggccacttttattcttaactatctcttgtggcgcattatcaggtttccacgcaacgcaaactccattaatggcacgttgtacagaaaatgaaagtgaaggtcgcttcattttctacggtgcaatgattactgagggggtaattgcattagtatggtgtatggttggtcttgcattctatgaaaatccacaagcgttacaagatgcaatttcagcaggttgctccatgctaaagttgtgtatgatagttcgttacatttcttaggttttattggtggtatttttgcnatattaggcgtgattgttcttcctattacttctggcgatactgcattccgtgctgcgcgtttacagatagccgaaatttttaatgttgatcaacgttcattacctaaacgtttattaattgctgtgccgttgtttgtattaggttattttatttcaaccattgatttcagcgtattatggcgttatttcacttgggcaaaccaaatgacagcaatggtaatgttatggactgcagcgggatatttatatcgttatcataaattccactgggttgcgtctcttcctgcgtggtttatcacaacagtatgtgcacttatttgttctacaacaaaattggtttcggcttagattatcagctttctgtgtatctnggtttagcaacaaccatcgtttgtatcgtattgttcttcacaatgcttaaaccattaggtacgcgagatgaagaagcttatataaataattagtcaataaaattttatgaaaaaagnngtttgaattgtttattcaaacggcttttttattttgataaaaatcagttgctttaatgtggaattacttgcaagttgagcgaacaaattataaacttgccagaagtggagaaaagtggtgttttgtggagatttttagagattttctaaaaataagttcaatttttaaggcgtaatatgtttcgtggtgcaacggcggttaatttagattctaagggacgtgtagcgattccaactcgctatcgcgctgaaattcttgaaaagaaccaagggcaaatggtttgtactgtagatattcgtcaatcctgtcttttactttatccccttgatgaatgggaaaaaatcgaacaaaaacttctcgcactttctaactttgatcctacccaacgccgtttgcagcgagtaatgcttggtcatgccactgaatgtgagatggatgctcagggtcgtattttgcttagtgggccattacgccaacacgcaaaattagaaaaaggtttaatgttggtagggcaacttaataaatttgaaatttggagcgatgtagaatggcatactcaaattgcagaggatatagaaattggctccagcacagattttgctgctgatgcgttaaatgatttctcattatagaaaataatgtagtacttttatcttaaatttatgaatagcgaaaattccttttcttcatctgaacatattacagttttacttcacgaagccgtgaatggcttggcattgaaggagaatggcatttatattgatggtacttttgggcgtggggggcattctcggtttatcctttctcaactttcttctaatggtcgtttgatagctgtagatcgcgatcctcgtgctattgcagaagcacacaaaatccaagacttgcgttttcagattgaacataacagcttttcgcatattcctgaaatttgtgacaaattaaatttagtgggcaaaattgacggtattttgcttgatcttggtgtgtcttcccctcagcttgatgaagcagaacgtggttttagttttatgaaagatggcccgcttgatatgcgtatggatacaactcaaggtttatctgctgaagaatggttaaaacaagtgtccattgaggatttaacttgggtgttgaaaacttttggcgaagagcgtttcgctaaacgtattgccactgctattgttgatttcaataaaagtgcggtaaaaaatggcacagaatttttatcgcgtaccagtcaattggcggaacttatttcacaggcagttccttttaaagataaacataaacatcctgcgacgcgtagtttccaagctattcgtatttttattaattcggaattagatgaattagaaagtctgcttaattctgcgttagatatgttagcaccagaaggtcgtttatcaattattagtttccattctttagaagatagaatggtgaaacattttatgaaaaaacaaagtaagggcgaggatattcccaaaggtttaccattgcgagaagatcaaattcagcgtaatcaaaaattaagaattattggtaaagccattcagccaagtgatgcagaaattcaagccaatcctcgttcaagaagtgccatattacgtgtggcagagagaatttagcgatgtctgaaaataataagcctcgttatccgttacagcagattttagtcgaagatttattttcttcaaataagttagtggtgttgctgttaatagggattttagtttctgcaatggggacgatttggataacccataaaactcgccaattaatttctgaaaatggaatgttaattttacagcgtcaagcacttgagaatgaataccgtaatttacaagtgcaggaagctacggaaggggatagcacgcgagtagaatctattgcgattagtacattaaaaatgaaagttgtttcttcagagcaagaagttgaaattagagaataataggtaaaaaaaatggtgaaatttaattcctcgcgtaaatcaggtaagtcaaaaaaaacaattagaaaattgaccgcacctgaaactgtaaagcaaaacaagcctcaaaaggtgtttgaaaaatgctttatgcgtggacgttatatgctttctacggttcttattttacttggcctgtgtgctttagtcgcacgagcagcttatgttcaatctattaatgccgatacgttatcgaatgaagcggataagcgttctttgcgtaaagatgaagtattatcggtgcgtggttctattttagatcgtaatggtcagcttttatctgtaagcgtgccgatgagcgcgattgtggcagatccaaaaacgatgttgaaggaaaattcgcttgcggataaagaacgaattgcagctttagccgaagaattaggtatgactgaaaatgatttagtgaaaaaaattgagaaaaattctaaatctggttatttgtatttagcacgtcaagttgaattaagtaaagctaactatattcgtagattaaaaattaagggtattattttagaaacagagcatcgccgtttttatcctcgtgtagaagaagctgcacacgtggtgggttatacggatattgatggaaatggtattgaaggcattgagaaaagttttaattccctgcttgttggtaaagacggttcacgtactgttcgtaaagataaacgtgggaatattgttgcacatatctccgatgagaaaaaatatgatgcacaagatgttaccttaagtatcgatgaaaaattgcaatctatggtgtatcgtgagattaaaaaggcggtgtctgagaataatgctgagtctggtactgcggtgttagttgatgttcgaacaggggaagtgttagctatggcgactgcgccctcttataatccaaacaaccgtgtcggcgtgaaatcagagttaatgcgtaaccgtgcaattaccgatacttttgagccaggttctacggtaaaacctttcgttgttttaaccgcacttcaacgaggtgtagttaaacgagatgaaattattgatactacgtcctttaaattaagcggtaaagaaattgtggacgttgcaccacgtgctcagcaaactttagacgagattttaatgaactctagtaaccgtggtgtaagtcgtcttgcattacgtatgccacctagtgcattaatggaaacttatcaaaatgcaggtttaagtaaaccgacagatttaggcttgatcggagagcaagttgggattttnaatgcaaatcgtaaacgctgggcagatattgagcgtgcaacagtcgcttatggttatggtattactgcgacacctttacaaattgctcgtgcctatgcaacccttggtagtttcggtgtttatcgtccgctttctatcactaaagttgatccgccagttattgggaaacgggttttctctgaaaaaataactaaagatattgtgggaattttagagaaagtagcaattaaaaataaacgcgcaatggtggaaggctaccgtgtcggcgtaaaaacaggtacggcacgtaagattgaaaatggaacattatgtaaataagtatgtggcatttactgcgggtattgcaccaattagtgatcctcgttatgcattagtggttttgatcaatgatccaaaagcaggagaatattatggtggtgcggtttctgcccctgtattctctaacattatgggctatgcgttacgtgcaaatgctattccgcaagatgctgaagcagctgaaaacacaacaacgaaaagtgcaaaacgtattgtttatattggcgaacacaagaatcaaaaagtgaattaaggaaaaattatgaaaaaactcaccgcactttttaatttgcctgaattaaagaatgatatagaactccataatatggtgttagatagccgtaaggttaaagctggcgatctttttgtggcgataaaaggtcatcaggtggatggaaatcaatttattgattctgctcttcattctggtgcgagtgcggtggtttctgagacagaattatccagcgagcatttaactgtagcgtttatcgggaatgttcccgtagtgaaatattatcaacttgcacatcatctttcatctttggcggatgttttctatgattcgccctctaacaatttaacccttgttggtgtcacggggacaaatggcaaaaccactatttctcaattattagcgcaatgggcggaattattggggcatcgtgcggctgtgatgggaaccattggtaatggactttttgggcaaattgtagaagctaaaaatacgacaggttcagcagtagaaattcagtcatctctttcagctttcaaacacgcaggtgcagattttacctctattgaagtttcatcacacggtttggcgcagcatcgtgtagaagccttgcattttaaagcagcaattttcacgaatttaacccgtgatcatctagattatcatcaatctatggaaaattatgctgcagcgaagaaacgcttgttcactgaattagatacccaaattaaagtgattaatgctgatgatgaaattggataccaatggctaactgaactacctgatgctattgccgtaagtatgaatgcggattttaaagtaggttcacaccaatggatgaaagcaataaatatccattatcattttaaaggtgcagatattacttttgaatctagctggggtaatggtgttttgcatagcccattaattggtgcttttaatgtaagtaatttattattagtaatgaccacgttgttatcgtttggttacccattggaaaatttactcgctacggcgaaatctttaaaaggagtatgtggaagaatggaaatgattcaatatccaaataaaccaaccgttattgtagattatgcgcatacaccagatgcgttggaaaaagcgttgattgctgcgcgtgaacattgccaaggcgaattatggtgcatttttggttgtggcggagaccgtgatagaggcaaacgtccgttaatggcacaggttgcagagcagtttgctgaaaagattattgtgacaaaagataatccacgaacagaatcacaaagccaaattgaaacagatattgtcgctggctttaaaaatatggaaaaagtggggattattcctgatcgcgcacaggcgatccagtttgcgattgaaagtgcggtagaaaatgacgtgattttaattgctggaaaggggcacgagcattatcaaattattggttcggaagttgtgcatttttccgaccaagaaattgcacttgatttcttaaaataataatcactcaattatgattaaactctctactgtacaacttgcacagattcttcaagctaaattaattggcgatgaaaatgtgcaagttgaaaaaattaatacggatactcgaaaaagcgtatcaaatagcttattttttgctttaaaaggcgaaaaatttgatgctcatcaatatcttgatcaagcggtgtcacagggtgcgcttgcgcttgttgttcagcaagaaaattcatccatttctgttccacaattggtggttaaggatacccgtattgccttgggtgaacttgcaaaatggttacgtgagaaaattaatccacgtactgtggcgatgaccggctcttctggtaaaaccacggtaaaagaaatgacggcaagtattttgcaacataccgcagcggattcagaagcggtactttttaccaatggtaacttcaataacgatataggtgtgcctttaactctacttcgcttaacagaaaaacatcgttttgctgtgattgaacttggtgcaaatcatcaaaatgaaatcaattacaccacaaaattagttcaacctaatgccgcattgattaataatattgcgcccgcacatttagaggggtttggttctttagcgggggttgttcaagcaaaaggcgagatttatcgaggtttaacaaaaaatggtgtggcgattatcaatgctgaacataatcacttagatatttggcaaaaagaaatcagtaatcacgccattcaatatttcaacggtaaagattattctgcaaaaaatattcatcatacttctcaaggctccacttttacacttatttccccacaaggtgaaattgagattaccttaccttaccttggtgaacataatgtaaaaaatgccttggcagcgaccgcacttgcaatgaatgtcggtgccactcttacagatgtaaaagctggattagaacaacgttcacaagtgaaagggcgtttattccccattcaagtcacgcctaatttattgctgttagatgatacttataatgcgaataaagattctctgtgtgctgcgattgatgttttaaaaggttatgatgctttccgtattttgtgtgtcggtgatatgaaagagctaggcgaaaactctctcgctattcatcgtgaagttggacaatatattaatttggtaaatttagatttagtgtgttcttatggcaatgaaagtgcggttatttctgaggctgtttcgggtaagcattttacggataaaactgaaatggtggatttcttagttccacttattgaaaaccaattacaacaaaataaaaaagttgtggtgctaggaaaaggctcacgctcaatgaaaatggaagatgtgatctattcattaaaggataaaattaaatgttagtctggcttgctgaatatcttgttcgttacgaaaccgcgtttaatgctatttcttatattacagtccgcgcaaatcttgcattattaaccgcactttttatctcactttggattggccctaaagtgatcaaacgcttgcagatcttaaaatttggccaagaagtgcgaaatgatggccctgaaagtcactttgcaaaaaaaggcacacccactatgggtggtgtgatgattttattctctattggcgtaagtacgttattatgggcaaatcttgctaatccgtatatttgggtttgtttatttgttttatttggatacggcgcaattggttttgtggatgatttccgtaaaattacccgtaaaaatactgatggattgattgctcgttggaaatatttctggatgtctgtggtggcattagtggcaatcctttggctttattggcttggtcacgacactgatgccacccgtttagtgattccattctttaaagacattatgcctcaattaggtttgttctatattgtgttatcttactttgtgattgttggcacgggtaatgcagtgaatttaaccgacggtttagatggattagcgattatgcctactgcgcttgttgcaggtgcgtttgctttaattgcttgggctacaggtaacgtgaatttcgcagaatatttgcacattccgtatattaaatacagttctgaagtagtggtgttctgtacagctattgttggcgcgagtttgggattcttatggtttaatacttatccagctcaagtatttatgggggacgtgggttctctagcattaggtggtgcgctgggtgttgtagcaattcttgttcgtcaggaatttttgcttgtgataatgggtggtgtatttgttgttgaagcactctctgttattttgcaagtagggtcttataagttacgcaaacaacgcatttttagaatggcaccgattcaccaccattttgaattgaagggatggcctgagccaagagtgattattcggttttggattatttccttaatgctggtgttgatgggattggtcaccttgaagttgcgttaataaatatagctaggttcgctctttcacttttgaaagagcgaccttttttacgttagtaaaggaaatttatatttccatcaatgatataattttaaaatttatagcaattaagaagaaagaaaatgaacgcctatcaaaacaaaaatattactatcatcgggcttggcaaaacaggtctttcttgtgtggattatctcttatcccaacaggctaatattcgtgtgattgatactcgaaaaaatcctactggtattgataaacttcctcaaaatatccctcttcatactggtagtttaaatcaggaatggttacttgaaagcgatatgattgttattagcccagggcttgcggtaaaaacaccagaaattcaaaccgcacttaaagcgggagtggaagtaatcggcgatattgaattattctgccgcgcagcgacaaagccaattgtggggattacaggttcaaatggtaaaagtaccgtaactactttagtttatgaaatggcgaaagctgctggtgtgaaagttggtatgggcggaaatattgggattcccgctttgtcattgttgaatgaagattgtgaactttatgtactagagctttctagttttcagcttgagacaacttatagcttaaaagctgcggcagcgactgtcttgaacgtgactgaagatcatatggatcgctatatggatttagaagattatcgccaagcaaaattacgcatttatcataatgctaaagtaggtgtgttgaacaatgaagataggctgacttttggggaaaacgaaaatcaagcgaaacataccgtttcttttgcggaaaatagtgcggattattggctaaaaactgaaaatggcaagcaatatttaatggtaaaagatgaagtgattttaccttgtgaagaagctacattggttggtcgccataattatatgaacattttggcagcaacagcattggcacaagctataggtattaatttagattcaattcgtaccgcacttcgtcatttcaaagggttagatcatcgttttcaattagtgcatcaagctaatggcattcgttggattaatgactctaaagcaacaaatgtggggagtacagttgctgcattggctgggctttatattgagggtaaattgcatttgttgctaggcggagacggaaaaggggctgatttttcagaattagctgaattaattaatcaaccacacattatttgttattgttttggtcgagatggtgcgctgcttgcaaaattttcatcgcaaagttatttgttcgatacaatggaacaagcgatagaatttttacgcccaacattgcaaagcggagatatggtattattgtcgcctgcttgtgcaagtctcgatcagtttgcttcttttgaaaagcgcggcgaagaatttacgcatttagctcaatgtttaacctaatttagtaactcacgaaataagatggaatttttacaaaatatcaaaaaaaattacgatgaatggacacgcatcacacctcaaggtttgttgtatgatcgcgcactattttggttatttgttattttgcttttaattggtttagtggcagtaacatctgcttctattccttatagctctcgtttatttaatgatcctttttactttgcaaaacgcgacgctatttatgtgctacttnctttactcacttgttatatttcattacaaatttcttcttcgcaatgggaaaaatggcacgctaaaatttttttattttctgtcatattattattgcttgtcccttttatcggtacatcggttaatggcgcaaaacgttggatttcgttgggaatcttaaactttcaacctgcagaatttgcaaaattggctttgacttgttttttagcaagttatttcactcgtcgttatgatgaagtgcggtcgcgacatgttagtatttttaaaccgtttattgttatgcttgtattgggttgttttcttttattgcaacctgatttaggtagtacagtcgtgctatttattattatgtctgggatgctttttatcgtaggggcgaaaattttacagtttgtaggattgatagcattaggtggaatcttattcgtttggctagtattgaccgcctcttatcggttaaagcgatttataggttttttagaaccctttaaagaaccttatggcactggtttccaattaacaaactctcttatagcatttgggcggggagaaattactggcgaaggattaggtaattcaattcaaaaattagactatctgcctgaagcacataccgatttcattatggcgattatcggcgaagaatttggatttatcggtatattgattgttattcttttattaggtttattaatttttcgtgcaatgaaaattggacgagaatccttaatgttagaacaacgttttcgaggtttttttgcattaggtattggtttttggatttyctttcaaggctttgtgaatttaggtatggctcttggaatgctaccaactaaaggtttaacctttccactcgtgagttatggtggttcgagtattatcattatgtccgccactattggtattttattgcgaattgatcacgaaaatcgtttatttcgtataggtcaagcacgcttgcgtgatgattagagatagaaaagatgaaaaataaaaaattattagtgatggcgggtggtactggcggtcatgtttttcctgccattgcagttgctcaaactttacaaaaacaagaatgggatatttgctggttaggtacgaaagatagaatggaggctcaacttgtaccaaaatatggtattcctattcgatttattcaaatttctggtttgcgtggtaaaggtataaaagctttgttaaatgcgccttttgccatttttcgtgcggtgttgcaggcaaaaaaaattattcaagaagaaaagcctgacgctgtacttggtatgggaggctatgtttctggccccgctggcgttgcggcaaaactttgtggtgtaccaatcattttacatgaacaaaatgcgatagcgggtttaacgaataagttattaggtaaaattgcaacctgtgtattacaggcatttccaactgcttttcctcatgctgaagtagtaggaaacccagttcgagaagatttatttgagatgccaaatcctgatattcgtttttcggatcgtgaggaaaaattacgtgtcttagtggttggtggtagtcaaggagcgagagtgcttaatcatactttacctaaagtagtcgcccagcttgcagataaattagagtttcgtcatcaagtaggtaaaggtgcggtagaagaagtcagccaactttatggcgagaatttagaacaagttaaaataacagaatttattgataatatggcagaggcttatgcttgggctgatgtggttatttgccgttctggcgcattaaccgtatgtgaaattgcagcagtgggagccgcagcaatttttgtaccattccaacataaagatcgccaacaatatttaaatgcgaaatatttatcagatgttggcgcggcgaaaattatagaacaggcagatttaacgcctgaaattctagtgaattatttaaaaaatttaactcgtgaaaatttattgcagatggcattgaaagcgaaaacaatgtcgatgcctaatgcggcacaacgtgtagctgaagtaattaaacaatattcaaactaggggttgtggcgttttataaatagcctcagtcataagtattttttatatccaaaagtgctaatattagaaataaaaacgttgcgaattttaaccgcacttttagttgagttttgtcattgggagaaaaggaaaaataaatgaaacattcccacgaagaaattagaaaaattatccctgaaatgcgccgtgtacagcaaattcatttcattggcattggtggtgcgggaatgagcggcattgcagaaattttattaaatgaaggttatcaaatttcaggttcagatattgccgatggcgtagtcactcaacgtttagctcaagctggggcaaaaatctacattggtcatgcagaagaacatattgaaggtgccagtgttgttgttgtgtctagtgcgataaaagatgataaccctgaattagttacatcgaaacaaaaacgcattccagtgattcaacgcgcacaaatgttggcggagattatgcgttttcgtcacggtattgctgttgcaggaacacacgggaaaacgacaacaacagcaatgatttcaatgatttacacccaagctaaacttgatccgacttttgtaaatggcggtttagtgaaatcggcgggtaagaatgcacatttaggagcaagtcgttatttaattgccgaagccgatgaaagtgatgcgtcgtttttgcatttacagccaatggtatctgttgtaactaatatggagccagaccatatggatacttacgaaggcgattttgaaaaaatgaaagccacttatgtgaaattcctgcataatttacccttctatggtttagccgtgatgtgcgctgatgatcctgttttaatggaacttgtgccaaaagttggtcgccaagtgattacatatggttttagtgaacaggcagattatcgcattgaagattatgaacaaacaggttttcaaggtcattacacggtgatttgcccaaataatgaacgtattaatgtgttgctcaatgttcctggaaaacataatgcattaaatgcaacggctgcacttgctgtagcaaaagaagagggtattgctaacgaggcaattttagaagctctggctgattttcagggggctggtcgtcgttttgatcagctaggcgaatttattcgtccaaatggtaaagtgcgtttagttgatgattatggtcatcatccaacagaagtaggcgtaaccattaaagcggcgcgagaaggctggggagataaacgtattgtaatgattttccaaccgcatcgttattctcgcactcgtgatttgtttgatgattttgtacaagtgctttcgcaagtagacgctttgattatgcttgatgtgtacgcagcgggagaagcccctattgttggcgctgacagtaaatctctttgccgttccattcgtaatcttggtaaagttgatcctattttggtatcagatacttcgcaactaggcgatgttctcgatcaaattattcaagatggcgatttgattttggcacaaggtgctggtagcgtaagtaaaatttctcgtggcttggctgaatcttggaagaattaatgccagatggattgattgaaaatcttagtattagaaaagtatcatcagtaagaagaaaaacaggatagaaaatgaacttaaaacaagaaaaaatcgcggtgttattaggcggcacatctgctgaacgtgaagtttctctcaattcaggcaaagcggtattagaagcattattaaagcaaggttataatgcacatcctattgatcctaaagaatataatgttgcaaatcttaaaaaggatggctttaatcgagcatttaatattttgcacggtcgtggtggagaagatggcacaatgcaaggtttattagagcaaattggtttgccttatacgggttgtggcgtgatggcttctgcattaacgatggacaaaatgcgtacaaaaatgttgtggaaagcttttggtttacctgttgcagatatgaaagtggttacccgagaaactttttctgaattggatcctcaggctgttgtggcaaaattaggcttaccattaatggttaaaccctctttagaaggctctagcgttggcttaacgaaagtaaaagcggtagaagagttaaaaagtgcggtggaatatgcgcttaaatttgataataccattctaattgaagagtggttagctggcgatgaattaactgtgcctgtgcttgacaatcaagtattacccgcaattcgtattgttccagagggcgaattttatgattatgaagcgaagtatatttctgataatacgcaatatttctgcccagcaggtttaacgcctgaacgcgagcaagcgttatcaacattagtaaaacgtgcttatgatgcagtgggatgtcgtggttggagtcgtattgatgtaatgtgtgatgcaaaaggtaatttccgtttggttgaggttaatactaatcctggaatgacgagccatagtttattcccaaaatctgcagcgacagtaggtatttcttttgagcaactcgtcgtgaaaattttggagctgagcctgtaatgaacattctgaaaagaaaaacgccacagaatattcgttttggagaacaaaagcctaaatattattttcatattcgggcttttgcggtattgcttggtgtcttttttttacttggtgtttattttaattggcaaagcattttagaaaaaatggatgataagccgattagcgcatttgcacttgttggacaaaatacctttactactgctgatgatattaaagaaagcctattaaaaatgggcgaattaaaaggattttgggggcaagatgtggcaccgattcaagagcaaattgaggctttaccttgggttaaaggtgcaatagtaagaaaaatgtggccaaatcgtttaagtatttgggtatcagaatatcaacccgttgcgttttggaatcaaaatcaatttgttacccttgatggtatcgtttttcagcttccctctgtacgtttaactgcaaaaaatttgccctatttgggtgggcccgattatcagagtttgaaagtaattgagacgtggaaccaaatttatattaatttaaaatcaaataatataatggcaaagggaattaatattgatgatcgcggtgcgtggcaggtccagcttgataatgatattgtgctaaaattaggtcgtggcgattggaaatcaaaacttgagcgatttgtcacaatttatccgcaaattgatgtgccagaaaacaaaaaaatagattatatagatttaagatatacggcaggtgcagctgtaggtatggttgatagataaaaataactgggtgcgaaaatggttaaaggtgtggaaacaaaaacaatagtaggtttagaggttggcacgtcaaaagtggtcgttgtagttggcgaagtatttcctgatggtgtagtgaatgtgcttggtgtaggcagttgtccttcaaaagggattgatcgtggcagcatcactgatcttgatgccgtggtgggttcgattcaacgtgctattgaagcggcagaatctatggctgattgtcagattatgagtgtgactttagccattactggagagcatattcaaagcctcaatgaaagtggttttgtgccgatagcagaaagtgaagtaacacaagaggaaatcgattccgcacttcatacagcaagctcaataaaattgccagaaggcttatctttattgcatgttattccacaagaatacgctgttgatcgtcagatgaacattaaaaatccattgggattacaaggcgtgcgtttaaaagcacaagtacatttgatcgcttgtcatcaagattggcaaaataacttaaaaaaagccgttgaacgttgtggattgcaagtggataaagtggttttctctggttttgcagcaacacattctgtgctaactgaggatgaaaaagatctcggcgtgtgtttaattgattttggtgctggcacaatgaacgtgatggtttatacgaatggcgcattacgttttagcaaggtaattccttacgcaggaaatattgtgacaaatgatattgcgcacgcttgtacaatttcgcgagcagaagcagaacggatcaaagtgaactatgctagtgcattttacccagctcgtttgcacggagataaaaaaattgaagtggcaagtattggcggtcgtgcgcctcgttcattaacaaaaagtgatttatctttaattacatcagctcgttatacggagcttttaggcgtggtaaaagatgaattagataagttaaaagctgaattagaagcaaaacatattaaatttgaattaattgcaggtgtggtaataactggtggtggagcgcagattgaagatcttaaagaatgcgcttcaaatgttttccattgtcaggtgcgtattgcgagtccattaaatattactggtttgactgattacgtgaatcgtccacaatattcaacggtggtgggactattgcaatataattacagtaatagtgatgatgatttaatttcaggaagtgatgattctgaaggaactttctttgaatctatttggcaaggagtaaaaaaaattgtcaataaagtgcggtcagaattttgattattttaatttttcatctacaataaagggaatttatattttatatatttagtcagcttatctggcagtaacggagaacatcaatgctatacccagagtaccctgagtacgataattttaacgaatccggcgcrctgatcaaagtcgtaggtgtaggcggtggcggtggcaatgccgtaaaccatatggtaatgaatatggtaaaacaagaaatgggcggaacctttgttggcgaaagttcattaacatcagaggaacacggtcgcatagtattttatgccgtcaatactgatgctcaagcattgcgtaaaagtcaagttcaacagaccgtacaaattggtggagaaacaaccaaaggtttaggtgctggggcaaatccgaatattggtcgtaaggcagctgaagatgatcaggatgaaatccgcaaaatgcttgaaggtgccgatatggtctttattgcagcaggtatgggcggcggcacaggtacgggtgcggcacctgttgttgctaaaattgctaaagaactcggtattttgactgttgctgtagtgactaaaccttttacctttgaaggcaaaaaacgtatgcaatttgcagagcttggtattaaagatttatcccaatatgttgattcaatgattattattccgaatcaacaaatccaaaaagttctccctaaaaatgctaaattaattgatgcttttgctgctgcaaacgacgtattgcgtaattctgtaatgggaatttcagatatgattacctctcctggtttaattaacgtggacttcgctgatgtaagaacggtaatgtcagttcaagggcaagctatgattggttttggttcagctgtgggagaacccggtgcaggtagagcagaagaggcagctcgtcttgcagtacgcaatgatcttctagaaaaaatcgatctttctaacgctcaaggaattttagttaatattactgctggaatggatttagtttttgaagagtttaacattataggtgagacaataggtagttttgcttctgaagaagctacagttgttgttggtacgagtttagtgcctgagatgagcgatgaaattcgtgtaactattgtggcaactggtctcggtgaaattgcaggaaatgaaccaattcaggttgttcgtcaagggctttctacgcagaatattgaaggtgaaggacgtgtaaacattgttcctgaacttcatcgtcgtgaatctgttgaagtgtcaagaactgcatcagaagaatatcaacggccgttagataaaccgattacagatcgcttggaagcatttaagaaaaataatttctttaatcctgcacagcgtgaagaaaattaataagtttcagnaaatacctagtaaatgaaggtagtagaatgattaaacaaagaacattaaaacaaagtattaaagttacaggcgttggcttgcatagcggtgaaaaagtgacattaaccttgcgcccagctatgccaaacactggtgttgtttattatcgtacagatttaaaccctgcggtggcattccctgctgatcctaattcagtgcgtgatacaatgctttgtaccgcactaattaatgaacaaggtgtgcgtatttctaccgtcgagcatttaaatgcagctttggcagggcttggtattgataatattattattgaagttgatgctcctgaaattccaattatggatggtagtgctagtccgtttatctatttgttgttagatgcgggaattgaagaacaaaatgcagcgaaaaaatttattcgtattaagcaatatgttcgagttgaagatggcgataaatgggctgaatttaagccttacaatggttttcgtttagattttactattgattttgaccatcctgctattggcaaagatgtacgtaactatgaaatgaatttttctgcccaagcatttgttcatcaaattagccgagcaagaacttttggctttatgaaagatattgaatatcttcaatctcaaggtttagtattaggtggtagccttgataatgcgattgttcttgatgattatagaattttaaatgaagatggtttacgttttaaagatgaacttgttcgtcataaaatgttagatgcaattggtgatctttatatggctggttataacattatcggtgattttaaagcctataaatcaggtcacggtttaaataacaagttacttcgtgctgttttagcaaatcaagaagcgtgggaatttgtaacctttgaagataaagcgcaagtgccacaagggtatgtagctccagtgcaagtgcttatttaattgttttattgttgaaaaagctatatttctggtgggaagtatagcttttttgtttcatctcgtgcttaaatagcgaatgtactaaaagtgcggtcaatttcgtgggattttttataaggaagcattatggcattagaattatctgacattcgccaacaaattacgcaaatagatcgtagtttattaaaattactttctgagcgtcatcgtttagctttcgatgtagtgagaagtaaagagatctcgcaaaaatctttacgtgatgtagagcgagaacagcaacttttacaagaactagtgcaatttgcagaaaatgaaaattatcagcttgaagcacaatatatcacttcaattttccaaaaaatcattgaagactcggtattgacccagcaagtctatttgcaaaataaacttaatgaacaacgtaatcaaaatttacatatcgcttttttaggtaaacgtggttcttattctaatttagctgcacgtaattatgctgctcgttatcaaaaacaatttgtagaactaggatgtcagtcttttgagcaagtatttgaaaaagttcagactggagaagctgactttggtgtgttacctttagaaaatacaacatcgggtgcaattaatgaagtttatgatttacttcagcatactgatttatcattagtgggagagttggcatatccaatcaaacattgcgtacttgtcaatgataagacagatttgaaccaaattgatacgttgtatagtcatcctcaagtgattcaacaatgtagtcaatttattcatagccttgatcgcgtgcatattgaatattgcgaaagtagttcacacgcaatgcaattagtcgcaagtttgaataaacctaatattgcagcattgggcaatgaagacggtggaaaattgtatggacttagtgtattaaaaactaatattgctaatcaagagaacaatattacgcgttttattgtggtggctaaagagcctcgcgaagtttcatcacagattcccacaaagaccttattattaatgacaacttcacagcaagctggtgcgttagtggatgctttattggtgtttaaaaagcatcaaatcaatatgacaaaactggaatctagaccgatttatggtaagccttgggaagaaatgttttatctagaaattgaagcaaatattcatcatccagatacaaaacaggctttggaagaactaaaaaattatagtaattacttaaagattttaggctgttatcctagtgaaattgtaaagcctgtgagcgtgtaaaaaaagtgcggtcaataaaaataatgtttttatgaccgcactttttatatttttttgttccgttctaaagatttatgttgaattttcaccgtttttcctttggcttgaaaatattcgcctaattgctgggcaatataaacggagcgatgttttcccccagtacatccgatggcaatcgtcaaatagctacggttatttttttctaacatcggcaaccaagtatcaatgtaatgacgagtgagataaataaattcattgacttctgtatgactatttagaaattctgcgacaggggcttctaatccagtcattgggcgtaatgttggatcccaatgggggttaggtaaaaatcgtacatcgaaaacataatccgcatctaaaggaatcccatatttaaaaccaaaagattcaacaataatttttaattctttttcactattaccgcgtaaaaattcgcgtaatcgctctgcaagactatgcgtagaaagatgggtggtatcaagaataagatttgcgtgttgaatcaatggttcaagatagcgatattcttcatcaattgcggcttcaagagataaatcttttaatgaaagcgggtgcaaacggcgtgaatcgctatatcggcgaatcagggtggcacgatcagcctctaagaaaatgattttaatctgatgatgcttttgtaatgttgaaagggtttgcttaagagaatgagcggagtttggaatattacgaatatcaagactgatggcgacagatgattgggattgagatagaatatcagtcaattgaggaagtaaatccagaggaatattatcaacacaataatatccggcatcttctaatgctcgtaaggctacagattttcctgcgccagaacgtccactaataatgataatttccataagtttccccactgtaattattctttcacttcttcaaatgtcgtttctgattgatcggtaatttcaaaaacttgccaaatttcatccgcacttttggctgatcgtaattgtttcaacacatttttatcagtcagtttttctattaatgatgctaaaactggaatgtaggtttcacattgattttctggaattagcaaggcaaagattaaatccactggtttaccatcaaaagcatcgtaatcaatcggattatcgagttgcataaacactgcgattgctttatctgatactgttacggggattttcgcttttggcattgcaatcccatttcctaaaccagaattccccagtttttcacgttcaaaaaggcattcaaaacaggcttgttcgcctttttctgcaaggatttgttcttctacaaaatgcgcaatagactcaaataatcgttttttgctagaaaaactaacgccctgacgaatattttcagggcttaatagttcagttattttcatttttataatttgaattgttcgccaagataaacgcgtttaacctgttcatcgttcatcacttgttctggtgtgcctgttgcgataattttacctgcgccaacaatataagcgcgttcgcaaacatcaagggtttcacgaacattatggtcagtaattaatacacctaatccacgattgcgcaaatcagtaataattttcttaatatcgctcacagaaataggatctacaccagcaaaaggttcgtctaatagaataaattttggatttgctgctaaggcacgtgcgatttctacacggcgacgttctccgcctgataaggcttgccctaaattatctcgaatatgactaatgttaaattcttcaattaattcatctgctttttcgcgacgttgttgtggggttaaatctttacgaatttccaataccgccatcaaattttcatagacagtcaaacggcgaaaaatcgaggcttcttgcggtaaataaccaatgccacgttgcgcacgattatgcattgggagcaaactaatatcttcgccatcaataacaattttaccttgatcttggcgaacaagcccaacgaccatatagaaagttgttgttttacctgcaccgtttggcccgagtaaaccaacaatttcattagaatttacggttaaactaacatccgaaacaactttacgacttttgtagcttttagctaaattctctgcagtcaaaattgacatagattacttccctttagcttgttgtaattgagatggaataagaactgttgttactcgtgattttccattaccattagctttaagttgttgttttttcacatcataggtaataacactgccattaattttactatcaagctgctttaattcggcattgttagttaatgttaaaaattcgttaccaagatcataatgaactttatttgcttttccatccactggcttaccattatctaactgttgatggaatgtgactggcgtgccgaatgcttctacggtttcttttttccctgatttttcagcaggacgagtgatgacaactttatttgctttgataacaatagacccctgtgtaattaccacattatctgtgaatgtcactacacttttttccatatctaaggattgattatccgaaacaatatttatcggctgattaacatcatctttcaatgcaaaagctgaacttgatgctaataccatcgttgcaagaaaaagaattttattgcttactaacttcataatatgtttttacctgttcctttaatgtcgccacttgttggcgtaaatttccgactaattttaatcctgtagaactaaaatttttacccttaattttaacctgtgtttcggaagttatatcctgtgttttcaaattgacgaccgctgattctgtttcaatgcgttgcaaacgtgaatctgatgttaaattttgcgcgacgacattaccctctaaatacaatatttgatcttttgtcaatcttgcttgatttgcgcttaatttccagctttgtgtgctaaaaaaatctacattttgattggcatttttttccttttccttttcatttgatgttgtgggatataaataaactaaaggcgcggtaaaaagggtttgttcattgactgtataatgctcaattttatcggataaagccaaatattgttttttaccatcaggggaaaaaaccgtagtttccattttataacccacataatcaggactatctggctttttcacaagttcagataaatctgcggtttcctgatttaaggaataaaaccacgccaaagcacaaagtgcgataacgcccaaaattacattccaacgaatattcatttttatttcaatcacttatccacaaagtgcggatgaaaatttcaatgtttttaatcttccaacattaataccttgagcatttgataaatttctcgataggctttcgatggtttattttgctccagttctttttgtgcagaacgaatcagattgcgtagttgctgacgatcgccattaggataatcatttaataaatctgttaaagccacatcgcctttttccaccaattcatcccgcactttttcgattttatgtagcatagcttgttgttggttatgcttattttcaattttatctaaggcttcacgaatgggctcaacatcaattcctcgaaataatttgccgatatactgtaattgacggcggcgagcttctttttgtaaacgctgtgcaagttcaatggcatcaagtaaggattcatcaagtgggattttggcaagattagctttggttaaattgacaatcttttcgccaagttgttttaaatcttccgcatcgcgtttgatttcgcttttactcacccaaataatttcttcttgatcttcatcttcccaatcgaaaacttcttttttcttacgttttgccattttttatcctttataaaaattggcgtgcattttaccataaactttaaaaataagataaaatgttgaaaatttttaataggaaaaaataatgaaaccagctgaaaattcaaccgcacttttaaaagcacaagaacaagaattacgtcaagccgtcagttttgcagtggagttagcaacgaaagctggcgcaagtgcagaagtcgcggtcacaaaagtgagcggtttatccgtatctgctcgtttgcaagaaattgaaaacgtagaatttactaatgatggcgcattggggatctccgtttatatggggcaacaaaaaggcaatgcttctacttccgatctaagcgaaagcgcaattaaaaatgcggtagaagccgcacttgcaattgcaaaatacacttcacccgatgattgcacagggttggctgataaagatctaatggcttttgatgcgcctgatttagaactttatcatgctgctgatatagatgttgataaagcgacggaattggcacttcaagcagaacaagccgctttgcaagcggatgaacgcattataaatagtaatggtgcaagttttaattcacatacaggcgtgaaagtttatggaaatagccatggcatgttgcaaagttatttatcaagccgttattccttatcttgttcggttattggtggcgtagaagatgccttagaaaatgattacgaatacacgatctctcgtgaattcgataaactccaatcgccaatttgggttggcgaaaattgtgcaaagaaagtcgtttctcgtttaaatcctcaaaaattgagtacacgagaagtgcctgtcattttcttaaatgatgttgcaactggtattatttctcattttgccgctgcaataagtggtggcagcttatatagaaaatcaagtttcttactcgatcatttaggtaaacaggtcttaccagattggtttagcatcagtgagagaccacatttattacgtcgtttggcttctacgccttttgatagtgaaggtgttcgcacgcaagatcgtgaaattgtcgaaaacggcatattacaaacttatttagtgacaagttacagtggtaaaaaacttggtatgtcaagtacaggtcatgctggaggcattcacaactggcttgttaagccaaatttaacgggtggattgaccgcacttttacgtcaaatgggaacaggcttactcgtaacagatgttatggggcaaggtgtcaatattgttactggcgattattcccgtggcgcatcaggtttttgggtggaaaatggggaaattcaatatcccgtcgccgaaattactattgcgggacaattgcaagatatgttgaagaatatgcttgctgtagcggatgatatagagcatcgttctaacatccaaacgggttctattttgttagataaaatgaaaatttcaggaaattaagaatatttttgaaattgagaataattcttattgacaatgaatgaatatctgttactatacgcacatctgttaagcgattgcaggttgctccaacaggtagagtagaaagtaaattcgttagggttcaaaaaggctgaaggtttaaacttcagccttttttttgtaaaatagcaaacgattttatcccctgtcatttcataaggaaacacaatgaaaaaacaccacgtagatgttttaatttcagagaacgatgttcatgctcgtattgctgaattaggtgctcaaattacaaaattttatcaagaaaaacagatcgataaccttgttgtcgtagggcttttacgtggttcctttatgtttatggcggatatcgttcgtcagataaatttacctgtggaaattgaatttatgaccacttcaagttatggcactggtatgaccacgaatcacgacgttcgtattaccaaagatttggacggcgatataaaaggtaaacacgttttaattgtggaagatattattgatacgggctatacgttggaaaaagtgcgtgatattttgaatttacgtgagcctgcgagccttacaatttgtacgttacttgataaaccctctcgtcgcgaagtggaagtgcctgttgaatgggttggttttgaaattcctgatgaatttgttgtggggtatggtatcgattacgcgcaacgccatcgtaatttaggctatatcggtaaagttgttttagaagaataatttgattttattgaaaagtgcggttgaaattttaaatgaatttttagccgcacttttttatattatttcattgctattttctcgatcacttgctaaatctttttacagcaaatacagccgttatattgataatcttgctggggcaattttcttatttttcggcggctatttagtttattcgggcgtgctagccactgcagccgcattttaattaccaaaaagcataaaatataacgaaagaaaacttgttatttttgctgaagttgatagtctccaaacactttaatcagttttggagattttttatgttattagtcaatttggcgatatttattgcttttttattgctgttagcacagctatatcgcaaaaccgaaaaattagggcaaacggtatttatcggtttattgctcggtttgctttttggtgcggtattgcaatctgcttttgaaaaacctttgttagacaaaactttagattggatcaacgtggtcagtaacggttatgttcgtttattgcagatgatcgtgatgccgttggtgttcgtgtcgattttatctgctatcgctcgtatcaatcaaaccagatcattgggcaaagtcagcgttggcgtgttatccaccttgctgattaccaccgccatttccgctgcaattgggattgcgatggtgcatttatttgatgtgtcggcggcaggattaatcgtgggcgatcgtgaattagcggctcaaggcaaagtgttagataaagcagggcaagtgtccaatttaactgtgcctgcgatgttggtgtcctttattccgaaaaatccttttgctgatctcacgggtgccaacccaacgtccattattagtgtcgtaattttctcagcattacttggcgtggcggctttgagtttaggcaaagaagatcaagcacttggcgaacgaattgcacaaggtgtagaaactttaaacaaattagtgatgcgtttggtgcgttttgtgattcgcttaaccccttacggcgtgtttgcgttgatgattaaaatggctgccacctcaaaatgggcggatattgtcaatttgggcaattttattgtggcttcttacgctgctattgccttaatgtttgtggttcacggcattttattgttcttcgttaaagtcaatcctgtggattactacaaaaaagtgttgccaaccttaagttttgcgtttacatctcgctcaagtgcggcaacaattccgttaaatattgaaacgcaaaccgcaaaattaggtaacaacaatgtcatcgccaactttgctgccacattcggtgccactatcggacaaaacggctgtggcggcatttatccagcgatgcttgctgtaatggtcgccccaatggtcggcattgacccttttagtttcagctacattctaaccttaattttcgtggtcgccatttcttcattcggcatcgcaggcgtaggtggcggagccacattcgccgctatcgtcgtgctatctacgttaggtttaccactggaattaatcggtttactcatttccatcgaaccgatcatcgatatgggacgtaccgcacttaacgtaaacggtgccatggtggcaggcacgattacggatcgcttgctaaataagtaactggaaatcaataaaaaaatctgcaattgagaattcagttgcagattttttatcgctcaatacttttgactaaaaagtgcggtggtttttttcagtgttttataacttaaatcgatgaataatttggtttgcggaacctcgccaaactaaacttgggtctgcctgttcttgaataaatttcccatcaattaacacatcaatataaggcaacattgcacgttgttgtttgtctaattcatctagcttataacccgtccaaacccagatgtctttatcgggacattctcgttttacacgttgcacaaagggcaataatgtttctacgttgaggggatgaagtggatcgccacctgaaagcgtcagaccttggcgtttaatgcgtgtgtcttttaaatcattgatgatttgttgttccattacgtcatcaaataatacacccgctgaaaatgaccaacttttttggttgtagcaacctttgcaagcgtgcgtacagccactgacgaaaagtgtgcatcttgtaccttcgccattgataacatcggtcgggtagtattggaggtagttcatttcataagaatcctaaaaatgtggcttaaattctcgccaaattcaccgcacttttgaattagtctttgcaatacggcggtaatttctgcataatagtgcacaatcgcattgcgatatcaatggaaaccttctcggtctctcgcaacggtgtctggtttactcggtcaggtccggaaggaagcagccaaagtcggaattactgtgtgccgagaagaagctgggaaggtttccgcccaacttccttttcttatactcgctcaatcaatcttttaaagaacccattttcttttgtgattaaactattgtaatcgccttcttcgattaatcttccgttatcaattacacaaattttatcgaattgttcaattgaactgagacggtgagtgactataattagggttttattttcggcatgttgcagaattaaacgtaaaatttgacgttcagtttcgcgatctaagccttctgtcggttcatccaataataaaattgacgcattattgagtaaaatacgcgctaaacctaaacggcgttgttccccgccagaaagtgggcgaccaccatccccaagccaaagatttaaaccctttccctcttgctcaagtaatttacttaagccaacttgatgtagcatttcaatcatttgttcatcagaaattttatccgcacttgcaaattgtaaattttgacgaagtgtatcgctaaatacatgaacacgttgagttaaaaaacaaatttggtggcgtaatgtttcttctgaataggcggaaatgggtttttctgccaataaaagctcaccttgattcgcatcataattgcgtactaaaagttgaagaagtgaagattttccacttccagttttgcctaaaatagcaatttttttgccctgttctaaatctaatgtcagattttttaatacaagcgtttcttgttcgggataggaaaaatttaaattcttcgcagaaattaaccgcacttttgtttcaaattcctcgttgccattaaactcaacaagcggtttttgctcaatgatttcggtcacacgctctgctgctgcaatcacttgacctatatgtaaaaatgccgcacccaatggcatgatgatctcaaaggcggcaagtgcagcaaaagtgaaaagtgcaatataagccgtgtgatattcatctgtgccaaaatcggcgttacttgcaaaccatagcattccagaaatcaacaaaccattaagaaagagaacaagtgcggtagagaatccgcttaattttgcttctttagcttgatcttcctgccatgttttttctgtgactaacattttctcttttaatttatcttctgcattaaataataaaagctcagcttgtgcttggataaattctaaaaactgggttcgataggtcgcgcgtgcttggattaagcgttcaccaaattgctgtcctagtcgatagaaaacagttgggataatcattaataaaattaacaaaaataagcctaaaccaagtgcgagtggaatattgataaagctaagtccaatcatcatggcaatgattacaaatacagcagtgaaaaatggcgcaagtaaacgtaaatagaggctatcaagtgtatccacatcggaaactaaacgatttaataaatcgctgttgcgataacgatttaacacagctggacttaaaggaatgattttttcaaatacttgcacgcgcaatttggacaaaatgcggaatgttgcatcatgcgtcactattttttcaaaatagcgcatgacggttcgtccgatagctaaacctcgcacactggctgaaggatagaaaaagttaaatagcgtgcctagtcctgcaatggctgtagcggctaaaaaccagcctgaaacggtaagcaagcccatactagagcccaaacctagaatcattagcaccaagcctaaaataagcgggaatttggcgaatttaaataaacgtataaacggaagtaatgtgcgcattattggatatcctgttgtcgttgagcgagtagttcagcaaagaaaccttcatgttgtaattcggtaaatttaccttgctgtactatttctcctcgttgcatcacaaaaatttgatcacattgtttcaaatcttcaattcggtgggtaatcatcagcgtagtttgatgctggcttgcttcattcaatgcttgtaaaacaagattttctgattgcgcatctaggcttgcggttggctcatcgagcagaagtaaatcgcctttgcgtaacaatgcccgagcaatggcaaggcgttgcgcttgtcccacagaaatgcctaatccaccatcttttatttcgtgatgaagtccaagtttatcggtaaattctttcgcttgagaacgcattaatgcttgattaatttcttcatcgttggcttgaacatcgccaagtagtaagttttctttaattgtgccttgtaataacaatggattttgtcctacccacgcaatatgtttgcgccagtcagctagattactttcgcgaagttcttgcccattaattttaagagaaccctcataaggtaaaaagcccaaaattacattcattaatgaggttttccctgcgccactttgtcctacaagtgcaacattgtgatttgctggaatttggaagtttaacggcttggttaatgctgaaccctgtgtcgaaagcaccactaaattttcggcagaaatttcaaccgcactttctaaagaaattgttttttcattttgatgtacagttaaataatcggattctaaaaaatcaacaatggcatctgcggcaccaatacctgctgcgcggtcgtggtaataagtgcctagatcgcgtaagggttgataaaattcaggtgcaagaattaaacaaaagaaacctgtgaaaagtgtaagcggtgcattataggtaccaaattcaatttgacctaagtagctaaaaccaaaatagaccgccatcagtgcaatggaaatagaggtaaaaaattccaatactgcagaagagagaaaagcgagttttagcacatccattgtggtttcacggaaatcttcagtggcattttcaatatgctccgtttgttcagaagtgcggttaaaaagacgcaaggtttccaaaccacgtaagcgatctaaaaattgggcactgaggcgagaaagggtatccatatttttttggctgttgtcagccgcagcaataccgacaatgatcataaacagaggaacaagcggtgcggtaatcattaagattaagcctgcagcccagttcaagggaaatacagcaatgaaaataaccactggaacaatggctgaaagactttgttgaggcagaaaacgggcatagaaattatgtaagttttcaacttgttccaacataatgcttgcccaacttccagctggtttttgattgattgtcgcagggccgacaagatggattttatccagaattttttgacgaatatggttgcgtaataattgtccgctttggaaacctattttttcgcgtgcccataaaataatagcacgcatcccgaagccgataattagcccgagnaaataaggaataagttcatcacgaggcacattttgcataatcagtttatcgagcaacgtcgcaagaaaataagtttgtgcgactaaaatgaatgaagaaagcgtagctaagacaatgtttgcacgcattaattttttgataggttcttgttgtgcgcgaagccatttttgtaaatatttttggcgaagtttattcattgttttggtcgtgattatagaaaaagttcccctctttaaaagagttaaaagaggggaattggttagaagatttatgcttcttgagcatctaaatagcgttctgcatccaaggctgccatacaaccagttcctgcggaggtaatggcttggcgataattgtgatccatgacatcgcctgctgcgaacacgccttccacagaagtggcagttgcattgccgtcaagaccagattttacaacgatatagccattattcaattctagttgcccttggaaaatttccgtatttggcgaatgaccaatcgccacgaataagccatctaatttgagttcttctttctccccagtttttgtgttggctaaacgtaatccagttacgcccatattatcgcccaatacttcatctaaagtgcggtcagtatgaagaacgattttcccttcttccacttttttgtataaacgatcgataaggattttttccgcacggaagctatcgcgacggtggattaaatgcactgtacttgcaatattggctaagtaaagggcttcttccaccgctgtatttcctccaccaatgacaccaacaggcttattacgataaaagaaaccatcacaggttgcacaagcagaaacgccacgacctttgtagttttcttctgaaggtaagccaatatagcgtgcagaggcacctgttgcgataattaacgcatcacaagtgaaattttgcacatcgccaaaaagtttgaatgggcgagaagataaatcgacgcgattgatatgatcgaaaacgatttctgtctcaaatttttctgcatgttgcaacatacgttgcattaaacctgaaccagtagtcatctcaaaatcgcccggccagttctcaatttcatctgtagtggtcagctgcccaccttgttgcaaaccagtcaccaatactggttttaagtttgcacgtgccgcataaatggctgctgtataaccagcagggcctgagcctaaaattaaaagttttgcgtgtttgatatctgacataaagaatccttgtttgtagttaagtaataatataatgcaataagttgcattttactgattataaactttttgcttagtaaagcagcgaataaagcaatcgacgaaatttatttgtcagcggatcagcattgcccattgcgcttaaaatagataaaaattgttgtttaacttcaccattctgcgcgcctaaatctgtttttaaaatgccgaaaagtagtgttaatgcttcttcatttcgtccagcttgatgaagttgtacggcaagttttattgcaatttcagctgttgggtttttagcataatcagcctgtaattgttggatttcaggtgtatcggctgcttgaatttgtagctcaatttgtgcttgtaatccgtgccaacggctgtctcgatcttgcaatggaatttgatttaaaatttcttgtgctggctccgtttttttcattgcaatataggtttctgcgtagagtagagcaacatcactatttttcttatctgaaagttcccacgcatctttcaataatggcaatgcagcttcgtaattttctacttgtaagaaatctaatgcttgttggaattttaaatcttcctctttaggtaaaataatgcttaatcgttggattaatgaagatttatcaagcacgcttggaaatgcatctaatgcctgtgcttctttaaacaaataggtggttggcaatgcttggatgcggaattgtgcggcaatcattcgctctttttcacaatttacttttccaagaataaattgtccttgatattgttctgcaacttgctcaagtagtgccaaaaaatccgccgattctttatgcgttggcgcgtaaaaattgatgacaagtggtttttcctaaggattgttgcagtatttcagtaagattttgttcgttgatctcaacgataaaaggaaaatcagccatgttttatccttgtgaaaaaaataatggctgattttagcaaagtgcggaagattttagaaacgttttaccatttctattattaagtaagtttttctaggatcaattttcccatcatttcaatatgtgcatgctctacattaagtgcaggaatatattgataagattgtccgccattgtttaggaaattttctcgattttcttcgtcaatttcttcaatggtttctaaacaatctacggagaaacccgggcaaataacggcaattttttgaatgttctgtgctgcagcagattctaaaaatttatcggtataaggttgcagccattcttcacggccaaagcgagattgaaacgtcattctccattggttttctgttaagcccagcttattaacaactgcaatagtcgtttgtttacaatgttcacgataataatcgcccattttttcgtaacgcagaggaataccgtgataagaaaataacaaaaactcatcggattttaaccgcacttttatggagtcggctaaggcattaatgtaattttcatcaatatgataagaatggatgaaatcaaaaggcagtaatcctcgttcttctttaagagcgttagcgaaagcatcaaatactgcgcctgtagttgagctagagtattgcggataaagaggcaagacaataattcgctcaacttgatttttaagcaaatttttcaccgcactttgcattgatggattgccataagtcatggcaatttctacttgagtatcgatattttgattatctaaataggcttgtaatgcgtctttttgttgtcgtgaaatagcaagtaaaggcgatccttgctctgtccaaatggcttgataatttttggcgatacgttttgaacgcaatggcaaaataatggctttgagtagaggataccatttgcaacggggtaaatcgaccacgcgaggatccgttaagaattgccataaataacggctaattgactttggcgttgggctatctggcgtgcctagattggcaagtaatacgccgatttttgctggttttgtcataaattgattacggaaagggttaatctagaaacacaacaaagtttattctcttctgtgcggatgtcaatttgccaaacttggatatttctgcccaaattaattggcgtggctcttgcagttactttacctgaacgcacagggcgaagatgattggcgttaatatctaatcccaccacagttttgccttcttccaaacaaagcgaacccgcaagagaaccaattgtttcagctaaagcaaccgaaaccccaccgtgcaacacaccaaacggctgcatagtacgatgatccactggcatcgtcgcttcaatccaatcctcgccaaaagctgaaatttcaatgccaagatgactcactgcactgttggagcaaagttgatttaagttttcaagggtaaaagtttttttccagagcatttaatctattccatattatcaattatcttggctccacccatttatggggggagctgccgaaggtgaggggggataaatgttcaatttcaacctaaattgttttaggtacattatctatgttttttaatatttcatcactccaaaattttatttcgcatatccctatatcccccttcccttcgggcaccttcccccacaagcaggggaaggcaagtttttaaaacctctaataagcagaaggcaagttatcattatttattttagaacctctaatcttggctccacccatttatggggggagctgccgaaggtgaggggggataaatgttgaatttcaacataaattgtttcaagcacattcttcttcccttcaggcaccttcccccgcaagcaggggaaggtaagtttttttaaaacctctaataagcagaaggcaagttatcattatttattttagaacctctaatcttggctccacccatttatggggggagctgccgaagtgagggggggataaatgctcaatttcaacataaattgcctcaagtacattatctatgttttttagtacttcatcattccaaaagcgaataactttatagccttgtgctgttaagaattttgttctttctaaatcatattgttcttgttctacgtgctgaatgccatctaattcaataacaagttttaattttctactgcaaaaatccacaatgtaatgaccaataataacctgtctattaaaacggataccgcaaaagagtttatttctcaaatggtaccatagtgcatattctgcatctgtcatattacgtcttaattctgtagcatattgggctaatcgtttatttttatttcgcatccctatatcccccttccttcgggcaccttcccccgcaagcaggggaaggcaagttatcattatttattttaaaacctcaagtaacgcctgcacaggatgcttcaacactacatgttcataacgttttacttgactgcggcaagaataaccggttgctaaacaaaagtgcggatcttttccatgtagttttttatgccatgatacatcgtagatttctcggctcattttttgattttgcacttcatgtccaaatacaccagccataccgcaacagcctactttttctacattcagttgttgtccaaatcttccaaaaatttcttgccattcttttggactattcggcataaaagtagattccgtacaatgagggaataaataccaacctaaagtgcggtcagttttggcgatgttttttaacttctcttgcaaatccgcattttgtaatctttgttttaaccattcgtgagcagtgagaacgtgaaaatcgccccgtttttcttgtagtgcttccttgtattcatctcgataagatagcacgatggctggatcaacgcctacaagtggaatgcctaattttgccattcgatttaaaaactcggcttggttttgtgctgttttgctaaagcgttttaagaaacctttaatgtgcattgctttgccgtttggtttaaatggtaacaaaattggtttaaagcctaatttctgcgtaagcataacaaaatcgcgaatcactttggcatcatagtaagaggtataaggatcttgcacaataaataaaatatcgtttttttctaccgcacttaggctttccaattcttctaaggatttgccttgataatgaatttctaccagctgttgttgcaaactgggttcagaaagcaagggcaaatcggtcatgcctagcgttttttccactaatgtttgcgtgacttttagcttggtaaaataattaaagaattttgcctgttttgccatataaggcgcagcgatttctaaatttgccacaatgtgatcttttgtggggcgtaagtagcggctgtgataaaaatgaaagaatttcgcgcggaaacttggtacatcaattttaatcggacattgactcgcacaggctttacaagcaaggcaagtatccattgcggctttcacttcgtgagaaaaatcataattgcctcgccatttttgaaccgtattgcttagtcgtttcacaagtgcggttagttttatttctgttttacggaagtctaattgttcgggcgaaacattttcatttgccatcaatcgaagccattctcgcaccatcgcagcgcgacctttcggcgaaaatacacggtttttactgactttcattgatggacacataatgctgtgttcatcaaaattgaaacataatccgtttccattgcagttcatcgcccccttaaattcatctcgtatttggataggaatttgacgatccttatcagctcgcatcggcgaaagaatagaataaagttcatctttggaatctaaaggcgtacagattttgccgggatttaagcgattgtttggatcgaataaggttttgatataacgaagttcgtgccagagntctggcgtaaagaatttttcgccgtaatgggaangcacgccttttccgtgttctccccaaagtaatccaccatatttaatcgtaagttctgctacttcatctgaaatttgtttaaataatttcacttgttctttatcgcataaatcaagcgcagggcgaacgtgcaacacgcccgcatcgacgtgaccaaacatgccatattgtaaattgtgctggtctaataaagcacgaaattcactgatgtagtccgcaagattttctgggggaacacaagtatcctccacgaaaggaattggtttggctgcaccttttgcattacccagtaagcccactgctttttttcgcattgcataaattcgctcgatagacggtaaatcagaacagacttgatagccaataatgtgatcttgattgtgttcaattttttcatcaagtaagcgacaaagtgcggtgacttggcggtctattttttctttattattaccagcaaattccacaatatttaaaccgagaattggatctttttcatcttctgtaagaagttcattcacagagtgccaaataatatcttgtttggcgaggtttaagactttggaatcaacggtttccacagaaagcgcattggctttcaccataaaaggtgcattgcgtaatgctgcatcaaaagaacgatatttaatattgatgagcgtgcgatactgcggaattagcagaagattgagtttggcttcacaaataaatgcaagagaaccttcagagccagtgagaattctggtgagattaaattcactttcatcttcattgaatacatttttcagatcgtatcccgttaaaaaacggttaagttgtggcagatctttaatgatagccgctcttttttctttacaatgttgcgcaatggtttggtggagctttttgctactctcacttaattcaagcgcatcaatgttttctaaaacatcaacagaattgaccgcacttgtatctaaaatttcgccatttattaagactgcgcgtaatgccaaaacatgattagaggttttaccatattgcaatgagccttgcccagaggcatcggtgttaatcattccacctaaagtcgctcgattgctggtggacagttctggggcaaagaacaaaccatgtggttttaaaaattgattaagttgatcttttactacgcctgcttgtactcgaacccaacgttcttttacattgagttctaagatggctgtcatatgacgagaaagatccactattatattgttattgatggattgcccatttgtgccagtgcctccaccgcgaggcgtaaagctgattgattgatattcaggtaaatttgccaattttgttatccgcactatatcagcaaccgttttcggaaaaagaattgcttgtggaagttgttggtaaacgctgttatccgtagccagacttaatctatctgcatagtttgtcgcaatatccccctcaaaatgttggcattgaagatcatcaagataatcaagtacatattgttcaacttgaggaatgcgatttagatttggcaacatagtatttgacccatttaaacatatcagatggaggctttgataatatcctaaggctagaataatgtcgattaggaaagagagaggagaaagtaaaaagtctgtttaagaaagtgttattttggataaaaactaaacaaaaaattcaaaagaatttgatcttttcaatttttataggataataagcgcacttttgaacgttcctttggggtaaacataagcaaaggaattgaatttgtcaaaaggtaataaagtagggcaaattcaaaaccctagttaagtgactgtttataatgtagctttaattaaaagttcagtataaacaaggacactttttattactattcgatcactaaatagaggacatcaaaatgaaaaaaactgcaatcgcattagtagttgctggtttagcagcagcttcagtagctcaagcagctccacaagaaaacactttctacgctggcgttaaagctggtcaagcatcttttcacgatggacttcgtgctctagctcgtgaatataaagtaggttatcaccgtaattctttcacttatggtgtattcggtggttatcaaattttaaatcaaaataacttaggtttagcggttgaattaggttacgacgatttcggtcgtgccaaaggtcgtgaaaaaggtaaaactgttgttaaacacactaaccacggtactcacttaagcttaaaaggtagctacgaagtattagaaggtttagatgtttatggtaaagcaggtgttgctttagttcgttctgactataaattatacaatgaaaatagtagtactcttaaaaaactaggcgaacatcacagagcacgtgcctctggtttatttgcagtaggtgcagaatacgcagtattaccagaattagcagttcgtttagaataccaatggctaactcgcgtaggtaaataccgccctcaagataaaccaaataccgcacttaactacaacccttggattggttctatcaatgcgggtatttcttaccgttttggtcaaggcgcagcaccagttgttgcagcacctgaagttgtaagcaaaactttcagcttaaactctgatgtaactttcgcatttggtaaagcaaacttaaaacctcaagcacaagcaacattagacagcatctatggcgaaatgtcacaagttaaaagtgcaaaagtagctgttgctggttacactgaccgtattggttctgacgcgttcaacgtaaaactttctcaagaacgtgcagattcagtagctaactactttgttgctaaaggtgttgcagcagacgcaatctctgcaactggctacggtaaagcaaacccagtaactggtgcaacttgtgaccaagttaagggtcgtaaagcgcttatcgcttgttttgctccagaccgtcgtgtagaaatcgcggtaaacggtactaaataattttagtatttgtttaacgaaagattaaatacagcaaaaggcttaaacttcggtttaggccttttgttttaaatgaatataaaaccaagcatttcaatcaagttttaacttgtgataaaatgcttatctcgtttatttatagggaacattatggaaaccttagacaaaatcaaaaagcaaattagtgaaaatcccattcttatttatatgaaaggttcgccaaaattaccatcttgtggttttcctgctcgtgcatctgaggcattaatgcactgcaaagtgccctttggttatgtggatattttacaacatccagatattcgcgctgaattaccaacatatgcaaattggccaactttcccacaattatgggttgagggagaattaattggtggttgtgatattattttagaaatgtatcaagcaggcgaattgcaaactttattagctgaagtggcagcaaagcacgcttaataacagtggaaaaataaaacccgcaataagcgggttttttatataataaatttccctttcattattaaataatagattaagcaaactttaataccttagaaagtgcggtgaaaaatttatcgttttcttcaggtaaaccaatacttatacgtaaatgattcggcatgccataaccagcaattgggcgaacgattacgccttctcgtaacaacgcatcataaattggtgcggcaggttgtttgaaatcaatggttataaaatttcctttagagggaatataatccaattgatttttttgacaaaagtcttcataacgtcgcatttctattcgattattttcagcaactttttcaacaaatttatcgtcattcattacggcaacagcagcggttaatgccaaagaattacagttaaatggctgtcgaactcgatttaataaatctgcgatttcgggattagataccgcataaccaatgcgtaagcctgccaagccataggctttggaaagagaacgtgaaataattaaatttgaatatttttttaataaactgaaagagtccactcgttcttcagatctagtaaattctgtgtaggcttcatctaataccacgattacattttcggggacttctgctaaaaaatcttcaatttcttgcgaggttaaaaaattacccgttggattattgggattagcaatgtaaatgagctttgttttatcagaaagtgcggtcaaaaatccttgtaaatcgtgcccccaatttttagctggaatttcttttacaattgcattaatcgctttagttactaaaggatacacaataaaggcatattgtgaatacatgatttcatcgccttccgttgcgaaagtgtgagcaaaaagttctaataaatcatttgagccatttccaagcgtaatttgatttggttgaacgccaaatttttttgcgatagtttgttttaattcaaagccattcgcatctggataacgagttagtttatctaattgttcgaaaattgctttttttgcactttctggaaaaccaaatgggttttcgtttgaggcaagtttaacgatattggaaataccaagttctcgttccaattcttcaataggtttgcctgcttgataaggggataaggattttacgccacgattggcaatgttgatgtactgcatagttgtatttataaatattgatatgggttagtatgtatttttaaataaatttgggcgtagtaaatacgcccattggaaatgtttttcctattgaggaagattttcagtttcaaattttttcataaatgaaatgagtgcctcaacaccattttgcgacattgcgttataaatagatgcgcgcattccacctaaaaccttatgacctttcaaggcttgcaagccagcagcagtagactctgcgacaaattttgcatctaattcaggattacctgtgatgaaagtgacattcattgttgagcggttttcttttgctaccacattgcgataaagtttgctcgaatcaatataatcataaagggtttgtgcttttagtgcattacgtttttcgattatttctaagccgcctatttctttaagatgtttaaatacgagggaacataaataccacgcaaaagttgggggcgtgttgatcattgaatctgcatcacgttgagttgcataattccaaatagatggggtttctttacgtgcattaccgattaaatcatcacgaataatgactaatgtaatgcccgcagggccaagatttttttgcgcaccagcataaattaccccaaatttactgatatcgatttgacgtgaaagaatatttgaagacatatccgcgaccaatacggcattgcccacatttggcacatcaaaaatctccacaccactgatggtttcattcgggcaataatgaacgtagtcatattgatcagcgatatggctaaaatcaagatcggtaattcgagtctgttcgccattttctacgatagtgatttcatcaatttctgcaaaatttcttgcttcttttgccgctgtagctgaccaatgcccactatttaaataaagggctttgccttttttaccgattaagttcatcggaatggtggcaaattgaccgcgagcaccaccttgtaagaaaagtgtacgatagttatcaggaatattgtaaacctcacgtagatctttttccgcttgggtaacgagttccataaaatactttccgcgatggcttacttccattacagaaacaccttgattgagccagtttataagttcattttgtgctttttgcaacacttctgggaaaatcatcgcagggcctgcgctaaaattaaagacttgtgacattgtatttccttgctttttatgaaaataatgatgtcttttttatcactacaaaaatcgataatcaatgctttttactgaaatcaaaaaaattctttctatcattcataaaatagagggtaaattttgacgattgattaaaaaaaagctaaattacggcacagtcattttatttattttaaagggagttgttatggaaattgtgaataaacaatcttttcaagatgtgttggaatacgtgcgtatgtatcgtttaaaaaatagaattaaacgagatatggaagacaataatcgtaagattcgcgataaccaaaaacgcatattgttgttggataatttaaatcaatatattcgtgatgatatgactattgcagaagtacgcggaattattgaaagtatgcgtgatgattatgaaagccgtgtggatgattacacaattcgtaatgctgaactttctaagcaacgccgtgaagcgagtacgaaaatgaaagaacagaaaaaagcacacgcagaattattgaaaaatgctgaaaaataataggataactagagccgactgaatcagtcggctctattttttataagccattcattgcgttaatgattttaatttcgtcaaaattgacaatatcttcttggaatattgtgcgttcttgaattttcccttcttgtaataatttttctcgttgtgtgcctaaaagcaatggcgtgtctggcgtgtaccatttttttccttggcgaaaaattaaattaccgatggaacaatctgtcacttttccatttttgataatcataatttcatcacaagcaccacgttgagcaaataatgtattaattaaactgcgatctgaatatttcaaactatattcaatgtcatcacaaattacaggttgaaaagtgcggtagatttttcgttggtattcaaaatattgaatttgtgtggtttcggcattgtaatcaatgcggcagcgaattaattgattttgtaaaggcgttggaagttgaatgagtgaaaaaagattaaaaattttcaccgcacttttaccataatattcacgcaaactacgttcatatcgcacttggtgtaaattgatattttgaattttcccgttttcaatacaaagggtttcaaatagaggatacattaatccgcaccttcaatcggtaaatagactttttctaacaattcttcatattcatcttgtgcattgctatgaatggtaattccgcctccactatgaaaataaaatttttcatctacttgggaaataaatcgaattgctaccgcactttgtagtgttttgccatcaaatatgccaaaaattcctgtgtaataaccgcgcttttgtttttctgcttgttgaataatttgtgtggttttttcttttggggcgccactaatagacccngcaggcaagagtgtcgctaaaatatccccaatttgattttgccagttttcattcaattttccgtaaatttcagaactggtttgcagtattttgcctttctgggtcttgatacgatcgatataacgaaattttttcacttgaatgtgttctgccaccatggataaatcgttacgcatcaaatcaacaatcgtgtaatgttcgcgttgttctttttcatttgtgagtaactgattttctgcatcgggcagggtggcattaattgtccctttcatgggataggtaaaaatattgttgtcatgaatattgacaaaacattcaggcgaaaagcaaacgaattgatcttgtaaccacaatttataaggtgcattggtttgatgaaaaatttgttcaagtgacagattacctgaaatttcagtggggtaggtgagatttaataaataagaattacctttttgtaattcactttgaacaagtttaaaaccttgttgataatgcgagaaaggcattggatgtttggtaaaattaagagggagaggccgtggagaaatcgtgcaatttcttttgcctaaaatatcaaaataaatgccttgttgtgcagaattttcgagaggacaaatcaagggtttttctttttcaaaatcaataagaaagaaaaatggcgtgcgttgtttgccataatgattagcctgttcaataaaatgttgcattgtgctttgtgccattttgcgtaaaatgacctgattataacgaataccgaactgttatgaaattactcatcattaataatcacgattcttttacttttaacttggtggatttaattcgaaaattaaatgtgccttatgatgttttaaacgtagaagatttgaaagaaaatacagcggaaaattatagccatatattgatttcgccagggcctgatataccacgcgcttatccacaacttttttccatgttggaaaaatattatcagcaaaaatctattttaggtgtgtgtttagggcatcaaaccttatgtgaattttttggtggtacattgtataacttagagaatgttcgtcacgggcagaaacgaacattaaaagtgcggtcaaattctccattgttttttgatcttccaactgaatttaatatcgggctatatcattcttggggcgtacaggaagaagattttcctgattgcctagaaatcaccgcactttgtgatgaagatgtagtgatggcgatgcaacataaatctttgccaatttatagtgtccagtttcatccagaatcttatatgtcagactttggcgagaaaattttgcgtaattggttggcgattcctcccacaactaacccataataccgcttgcttattaagcaaaaatgcgtattatagccgtctatacgtcaatacatccaaatttaaaagaagaagagagaaaatatgtctagttatttatttacatctgaatcagtctctgaagggcatccagataaaattgccgatcaaatttctgatgcggtacttgatgaaatcctaaaacaagatccaaaagcacgagtagcttgtgaaacttacgtaaaaactggtatggcattggttggtggtgaaattacaacatcagcatgggttgatattgagaatttaacccgtaaagtgatttgtgatattggttatgaacattctgaaatgggctttgatggtcattcttgtgcagtgcttaatgcgattggtaaacaatctgcagatattaatcaaggcgttgatcgtgaaaatccattagatcaaggcgcaggcgaccaaggtattatgtttggttatgccaccaatgaaacggatgtattaatgcctgcagccattacttatgcacatcgtttaatggaaaaacaatctgaagtgcgtaaaagcggtaaattagcatggttacgcccagatgcgaaaagccaagttactttaaaatatgaagataataaaattgttggtgtggatgcggttgtgctttctactcaacattctgaagaagttagccaaaaagatttacatgaaggtgtgatggaagaaattatcaaacctgtgttaccaagtgaatggctttctaaagaaacaaaattcttcattaacccgactggtcgttttgttatcggtgggccaatgggcgattgtggtttaactggccgtaaaatcatcgtggatacttacggtggtgccgctcgtcacggtggtggcgcattctcaggaaaagaaccatctaaagttgaccgttctgcggcttatgctgcacgttatgtcgcaaaaaatattgtggcagcaggtttagcagatcgttgtgaaatccaactttcttatgcgattggtgtggctgaaccaacatctatcatggtcgaaacctttggaactggaaaagttgcgaatgaattattagtgtcattagttcgtgagttttttgatttacgtccttatggcttaattaaaatgttagatttaatccaaccaatctatcgtgaaacggcagcttatggtcatttcggtcgtgaacaattcccttgggaaaaagtggatcgcgcagaagatttacgtattgcggcaggtttaaaataataggcttgaatttttagtttgaaaggattatattggaaagcaacaaggtttcttgttgccttagttggtttaggttgctaccaagctggggagctaaaggacagcaacaagaacccgataataatcattaatatgattttatcataaggctatctcctttcagagttgttaaacaaagctgatcgagattgagttactgcctgacccgccagtcaggcaataacgtacctgaccaaccactggttattctatcatataaaagccgcttatctagcggtttttgcttttaccgatgacatcaatatcacttattccattccgtcatttaaaaatggcaagtgcaacgcaaattgaatcagtctttgctgcttgcagaggcttattttaagcgaaaatttacaatgccagaggtaaattatgagttacgaggtataaaggcaggcgtggcttacctacaaaaaaatgaaataaaatttaaccgcactttattgcaagaaaatacggatgaatttattcgacaagtcgtgccacatgagcttgcgcatttgattgtgtatcaaatgtttggtcgcgtaaaaccacacgggaaagagtggcagcttgtaatgaatgaaatttttaagcttcctgcagacacttgccatcaatttgatataaaaaacgtgcaaggtaaaacctttgaatatcgttgtgcttgccaaacccattttctaactattcgtcggcataacaaaataatgaaagaaaacatcgaatatttgtgtaaaaaatgtaggggaaaattagtttttgtcgatgatgaagaataatttttgtgatatatttttccaatttattcaataaataaaggagttatccaatgaaaaaatctttattagcagttattgttgggtgcatttgcctttgcttctgttacaaatgcgaatatttatgctgagggcgatatcggtttatctcaaactaaagcaaacggtagtaacaatacaagagttggacctcgcgtatccgtgggttataaagtaggaaatacacgtgttgcgggtgattatactcatcatggaaaagttgatggcacaaaaattcaaggtttaggtgcatcagtattatatgattttnacacgaattctaaagtgcaaccttatgttggtgctcgtgtagcgactaatcaatttaaatacaccaatcgcgcagaacaaaagtttaaaagttcttctgatattaagctcggatatggggttgtagcaggtgcaaaatataagttagatggcaactggtacgcaaatggtggagttgagtacaatcgtttaggtaattttgatagtaccaaagttaataactatggtgcaaaagttggtgtggggtacggattctaatttttagaatataaaaatcttttttataaaacactttaatttaacggtgatcgtttaaaacaatcaccgttatttattttgggattatttcaatacgctaaaacccaaaacttaccccagttgcagcacccacaccgttattggtatcagcagagccagaaaggctaattaccatatttggtttaggcttataacgaactccagctgcaacagcagattgtcctcgataaagtccctgcagctacgccagtaatttggtgggttatgcctcttattttattccccactgaaaccgaacccgcagtgcctttccaagttgaaactaattcatttttagctgtttcataagatttagtcgcgttgtcaatcttagcttgatttggattagctgcggttttcaactgttccatattggcttttaacccattaacttcctcttgttttttcggaaaatcgtaaagaatattacgtaattctgtcaaatcagcataattttgacgctctgttttataagcattttccaatggcttaatatcaaaaatatgtgatcaagatcacaaaataaaaaatcccaacggagattgggatttaaaatcactaaaaattttaccgcactttatgctttgcttacttcaaaacgttcaaatgccaatacttttttctctaatttacgtagtaataatgttgcaatgcctgtgataattaaatagataccacccgcaatgccgtaaattgtgagtgcatcatattctgtaccatagagttggcgtgcgtaacccataatatccataatcgtaatggtggatgctaatgccgtgcctttaaataccaaaataatttcgttactgtaagaaggcaacgcacgttttaaggcataaggaattaaaatttttaaagtttgtatgcggtttaatcctaatgcgccacaactttcccattgtcctttgggaatggctttcactgcaccgtgaaataattgggtggaataggctgcactgtttagtgctaaagctaatgcagcacagaaccacgcattggataagacataccataatgggctgtcaataatccattggaattgaccgggtcctgcataaattaaaaagaactgtactaacagtggcgtgcctgtgaataaagtaaggtataaattgaccgcactttttatccatttattttccattgaaagtaaaaaagtaagaaataaggctaaaaagaaagcaatcagtaaggatacgacagtaagcaacaaactcgttggaatcccttttacgatcacgcttaaatattcttgaaacattatttcacgcccctttcaaaacgagtaaaacgcagctctaattttcgaataccaacttggctaattaatgtcactgccaaataaattaacgcagcaataccataccaagtaaaaggctgatgtgtattggtattaatcagatccgcttggtgcatcaaatcgtccacaccaattaatgaaaccaatgccgtatcttttagcaatacaagccattgggtgcttaaaccaggtaaggcgtgacgccatacttgtggcataacaatatgaatgaacgtatagcttttgcttaagcctaacgctgcacctgattcccattgtccttttggtatggcttgaattgcaccgcgtaatgtttgtgaagcataagctgcaaaaataagagaaagcgcaagcacgccacagccaaatgccccaaattcaatgtattctcctgtcagcatttctactaattcagtagaaccaaaatagacaagtaatacaacaataatttcgggtaagccacgtaataatgccacaaatactgtcatcggcttgccaacaaagcgatttgcttcaagcacggcaaaaataaggcttaaaaataagcctaagagcaatgaacagaccgcaagccctaaagtcattagagcagcggtaaacattaaagaaagaaagtcagaaaacataaattattttgttatccatttatcatagattttttggtattcgccatttgctttaattgcagctaaacctttgtttaattgtgcagccaaatctttgtttgatttgtgcattgcaatacctaaaccattaccaaaatattttttattggtcactttttcgcctataaattgaatttctggctctttggaaatcatatcggcgagcacggcggtatcgccaaaaataatgtcaatccgaccgctctttaagtctaaaatggcattttgtaaacttgcataggattttggactatattgcttggtttccgctacggtatattgttggaatgttgtaccattttgaacacctatattttttgcactttctaaggttgctttgcctttaagagcaacatagcttgcagagctatcgtaatacgcatcagagaataacacttgttttgcacgagcatcggtaatatcaattgcggaaattgctgcatcaaaacgttttgcttttaaatttggaattaacgcatcaaaggtttcgctcttgaatttacaggttgcttgaatttcttgacaaattgcatttgtcacatcaacatcaaacccgataatttcgccttttgcatttgtggtttcaaatggtggatagctaggttgcattgcaaaagtgagttcttgtgcacttgctgctacggatgcacctaataaaatggcagttaataatgtttttttcatcgtaagctccttattttctagtgagaaagatagtgtttaaattgttccgtttttggattttcaaagcaatcagccgatcccatttcgacgattttaccttgttccatatagacgacttttgtcgccactttttgcgccacattgacttcgtgggtcacaatcacttgcgtaatgccagtttcttgtaattctttaataatatctacaacttgcgcagtaatttctggatctagcgcagccgttggttcatcaaataatagaacttgtggcttcatcattagtgcgcgcgctattgcaacacgttgttgctgaccgcctgataaatgcaatggaaagcgatcggcaagttgttctaaacgtaaacgttttaacaattccattgcatcggttttcgcttcattttcactcacaccacgcactttcattggtgcttcaattaggttttcaattaccgttaagtgcggccaaagatgatattgttgaaacaccattcctacatcttggcgtaattgttggattgctttgggatttgccattgcattggataaattaaattcattatttgcaatacttaattcaccagactttggcacttctaacaaatttaatgtgcgaattaatgtacttttgcctgcaccacttgggcccagcaacacaacggtatcgccttcttctgcttcaaggttaatatcaaataacgtttgtgatgaaccgtaaaagaaattgagatttttaacacgaatagccatttttcttctctatgctttataagatgraaaaatattacatytttatgcataattatgcaagtgctattaataaaaaatcccaagaaattttgggatttaaaaaacttgattgaaatcaaccgcactttaggcttgttttgccatttcaaactcaattaacatcattaaaatatgaataactttgatatggatttcttgaatacgatctgcataacggaaatggggtacgcgaatttcaacatctgctaatcctgccatttttccgccatctttgcctgtcatcgcaatcactttcatgccttttgtttttgccgcttcaatagcatttaagatattttttgaattgcctgaagtggataaaccgaataacacatcgcctttttgccccaccgcttcaacatagcgagaaaagacatattcataaccaaaatcattacttacacagcttaaatggcttgcatctgaaatcgcaatagcaggataacctgggcgattttcacgataacgacccgttaattcttctgcaaaatgcatcgcatcacagtgcgaaccgccattaccacaagaaagcactttgcctccttgtttgaagctattcgaaattaataatgccgcttcttgaattaatttaatgttattttcgtcagaaataaatttgtttaacacatcttgtgcttccacaagttcagatttgatttgatctaaatacattgattgctccttgttgggaataaaatcgcgatggcattgtatagcagatgaagattcttcgctagcctaaataaaaattcatcttttttcgatgaaatgatgattttttgcgatttagatcgaaaaaataagtttgagtagttggggatttttcaagatatgtttatcttacgtaaattcttagccctttaattttcaaaaacacaatgaaattttaccgcactttgttacttttctttgctagttcttttgcttttgctaactcagatttaatgcttcttcatacctataataatcaacccatagagggttgggtaatgtctgaaaagttagatggtgtacgcggttattggaatggaaagcaattattaacccgacaagggcaacgtttatcgccgccagcttatttcattaaggattttccgccttttgcgattgatggcgaattatttagtgagcgaaatcattttgaggaaatttcatccatcacaaaatcttttaaaggcgatggttgggaaaaactgaaattgtatgtttttgatgtgcctgatgcagagggcaatttatttgagcgtttagctaaattaaaagcgcatttacttgaacatcctacaacttatattgaaattattgagcaaattcctgttaaagataaaacccatttatatcaatttcttgcacaagtcgaaaatttgcaaggcgagggcgttgttgtacgtaaccctaatgcaccttatgaacgtaagcgaagtcacaaattttaaaattgaaaacagcacgaggtgaagaatgtacggttattgcacaccataaaggcaaaggacaatttgaaaatgtgatgggtgctttaacttgtaaaaatcatcggggagaatttaaaatcggttcgggttttaatttaaacgaacgagaaaatccccctccgataggntctgtgattacttataaatatcgaggcattacgaatagtggaaaacctcgatttgcaacctattggcgagagaaaaaatgagcctatttataaatctgacaaaatgaatttaatcaatatggaaacaagcgattaattttccatcagtatgttgctccaagtgcggttgattttcacgacatttttctgtcgctttccaacaacgaggattaaatgcacagccttttggaggattaatcgggcttggtaattcgcctgtcagcttaatacgctcacggcgcaagtttggcgacaaacgtggtgtcgctgaaagtaacgctttggtataaggatgctgaggattagaaaaaatctgctctgtcgtccctttttcaatacaacgacctagatacattaccatcacttcatcagcgatatgttctaccacagaaagatcgtgtgaaatgaacacgtaagacaagcctaattcatcttgtaaatccatcattaaattcagtacttgtgcacgcacggaaacatccaatgcagaaacaggctcatcggcaacgacaacatctggntctaacattaaaccacgagcgatggcaatacgttggcgttgtccgcctgagaacatgtgaggataacgatcataaaattcagcgcgcaagcccactttttccatcatcgataaaactttttctcgacgttctttggcggaaagttttgtattgatgattaatggttcttccaaaattgaaccaatctttttgcgtggatttaacgatgcgtaaggattttgaaaaactatttgaatttttttacgacgtagtgcttttgtttcagaatcattttctaaaaaattatgccctttgtaataaagttcgcctttggttggttcttcaatcattgtcaataaacgacctagcgttgattttccacaaccagattcccccacgactgctaaagttttacctcgttcaagctgaaaagagacaccatccaacgcttttacttgctgtggttttgcaaacaagcctttttttacagggtaatatttttttaagccaatggcatttaataatggcgtattttcttttacttcattcgtcattattaagctccttgatattcaactggattgccttgctcgttcagcggagtatggcattttactttacgcgaaccgatatgatgcaattgaggttcaacttggcgacaatattcggtggcataagggcagcgaggatttaataaacagcctgttgggcgatcgtattttccagggacgaccccttgtaatgattctaagcgagattttccctctgcaaattcaggtaatgaacgtaacaaggcttgtgtgtaaggatgttttggttcgcggaaaatatcttttgcggtgccttcttcaacgatttgtccagcatacatcacgataattcgctctgccgcttcagccacaagtgctagatcgtgagtaatcaaaattagggacatgcattctttcttttgcaattcaagtaagagttccataatttgagcttggatagtcacgtccaatgccgtggttggttcgtcagcaatcaataatttaggtctgcaagcaattgccatcgcaatcatcacgcgctggctcattccaccagacagctgatggggataaacatcaatccgagattcaggatcaggaataccgaccaattttaaaagctctaaagtgcggtcttttctcgccttttttgtgccgccttcgtgagtttttaacgcttccataatttggaagcccacagtataagcaggattcaaacttgtcatcggatcttggaaaatcattgctacatcagcaccaataagctggcgtttagctttactctctaaagtgagtaaatcagtattttcaaattgcaaggattcagcagatacacgtccaggatgatcaattaatcccataattgcgagagaactcacagatttacctgagcctgattctcctacaatgccaagcacttcgccttgtgcgacttgatagctaatgcgatccactgctttaaatggcgtttttttatcgccaaagtgaacagaaagttcttttacgtctaataatgccattctgttttcctattgtttgagttttggatcaagggcatcacgcaagccatcgcccattaagttgaaagctaataccaaagataaaatcactaagccaggaattgtaactaaccagtttgccgcttgcataaaaccacgtgcttctgaaagcattgtgccaagttcaggtgttggtggttttgcaccaatgcctaagaaaccaagtgtcgcgagttctaagatagcattggatattcccatagtcatttgcacaattaaaggggctaaacagtttggtaaaatcacaataaacatgaggcgtaaaatacctgcccctgccactttagatgaagtcacataatcacgatttttttcattcatcatcgctgctcgagttaaacgcacatagctaggaatcgataccacggcgatcgctaaagtggcattggcgagtgatggctctaaaatagagacgactacaatcgtcaaaagtaagtttggaattgcgagcataatatcaattaggcgaatgataattgtatctagcacgccgccataatagccagaaatcaagccaaggctggtaccaaaggcgcaagatagtaatacgatgataaatcccgcaaagacggaaattcgcgttccataaataatacgcgaaagaatatctcgcccaatatcgtctgtgccgagtaaataagcaggattaccgccctcataccaagcgggtggcagtaaaagtgcggtacgatttttttctgttggntcaaaaggtgcaatataaggcgcgagaatgctgattaaggcaacaatcaaataaaaattaaaccaattagcgcaccacgattttktttaaagtaaaaccaaaattcttgtaagggtgtttttggcgcgaaagttaaaggcgtgtcagacataatttctcctacaattaatgacggatacgcggattgaccacgccgtaaagtaaatcgacggttaaatttaccacaataataatcgtcgcaataatcagtacagaaccttgcaacactggataatcacgggcttgaatggcatcaataatccattttccaatccccggccaagagaaaatagtttctgtgagaactgcaccagaaagcaattgagctacaattaacccgaccacagtgacaacaggaattaacgcattacgcaatgcgtgaacaataacaattcgagtatagcttaaaccttttgcttttgccgtgcgaatgtaatcttcgcctaatacttccagcattgcagatcgtgtcatacgcgtaataatggcgagaggaactgtgcctaggactattgcaggaagaattaaggatttcaccgcattttcgaaggcaccagaaacacctgaaagccagctatcaataagcataaatcctgttggtgtatcgatccaaaattcattatctaaacgcccaccttgtggcaaaccgagttgtggcgaaacatataaaattaaaattaaaccccaccagaaaatcggcatagaataacctgtgagcgatgcagctgtaacggtgtgagaaatccaactgtctttttttactgcggcaatcgtgcctaaaattattccacctaataatgaccaaaataacgcaaaaaaagctaattcagcggtagcagggaaaagcgtaaaaaattcagtaaggacaggttgttgagtgcggaacgatgcaccgaaatccccttgaattacattgccaatatagtggaaatattgctgataaagaggtaaatctaaacccaattggtgcatcatttgttgatgtacttctgccgttaagccacgttcccccatcataatttccacaggatcaccgggaataaaatgcacaagggcaaaggtaataagagtaatggcaataaaagtagggatcaccattaagattcgtttgaatacaaatttaaacattccatcactcgtagataataaaagtgcggtaaaaattcaccgcacncttcaaagaaattaatcggtaaaaaatataatactcttgaattctaccgcactttttccaattttgccaaatgcgcaatcaaccatttaatgccttgcgcttggaatgctatttgtaaacgtgtgttattttcagaaccttccacattaatcactgtgccgaaaccaaatttttcgtgtttaactttttgacccattttccattcattttcgaccgcactggtattcgacaatgaaccgacttttgctaggttcatcgcacgagtgactgtccctcgtaaacgaatttnttggatacattctctcggtaattctgcgataaaccgtgatggcaaatggcgttcttctttggcatataatcgacggctttccgcataagagatggtcagttttttcttcgcgcgagtaataccgacataagctaaacgacgctcttcttctaaacgtccgggttcttcaaaagaacgaaaacttgggaataatccttcttctacgcccaccataaatacacgaggaaattctaagcctttcgcagagtgcaacgtcatcatttctacacaagattgatgcggcgaggcttgttcttcgccagcttctaaggaagcgtgcgttaaaaaggcagtgagttcggtcatttcttccgcattatcaggtttgataaattcacgggttgcggtaactaattcttccaagttttcaatacgcacttcgcctttttcgcctttttcttgttgatacatttcatataagcccgaatgtttaatcacaaaatcagtttgtgcgaaaagcggcatttctgcggtatcaagttgtagtgaattaattaattcttggaaacgtaataaggctgttgaggctcgccctgccaacatattttcttgtgttgcgacttgtactgcttgccataaggtaatttggcgttcgcgtgttaagttacgcaatatatctaaagtgcggtcgccaatgccacgggttggcgtattaattacacgctcaaaagccgcatcatcttgacgattattaatcaaacgaagataggctaacgcatctttaatttcttgacgttcgaagaaacgcataccgccataaatacggtatggaatttgacaacgaattaaagcttcttcaataacccgtgattggctattactacgataaagtacagcgcaatcatcaagttttccgccatgttctacccaatcctgaatttgtgaagcgacaaattttgcttcatctaattcattaaaggcagaatagatgcccacaggatcgcctttctcaccctctgtccataaatttttaccaagacgatcactattgtttgcaattaattcatttgcgctgtttaggatattggcggtagaacgatagttttgttcaaggcgaattgtttcggctttgaaatctttcaagaatttttggatattttctatttgtgcaccacgccaaccgtatatagattgatcatcatcgcccacaatcatgacttggcctgtttttccagcaagaattttgatccatttatattggattttattggtgtcttgaaattcatccaccaaaatatgctgaaaacgttgttgataacgttgcaaaattaatggttttttctcaaataattcatagacccgaattaataattcagcaaaatcgaccaaccctgcgcgatcgcaagtgtcttgatagatctgataaattttaatccattcacgttcttggcgatcattaaaatcttcaatatcatttggtcgcaagccttcatcttttttgttattgatgtaccaacaagcctgtttaggcggaaaagctttttcatcaaaattatgtaattttaataatcgtttaattaaacgaagttgatcttctgaatctaaaatttggaaatcttgtggcaatcccacatctaaatgatgagctcgcaacaaacgatgagcaatgctatggaaggtgccaatccacataccaaataattgatgttgtgcgtgtttggcaagggtagattgaatacgatgacgcatttctgctgcggctttattggtaaacgtcaccgccataatgctgccttcagaaatattttcgaccgcaattaaccaagcaatacggtgcgtcaatacacgcgttttgcccgagcctgcaccagctagcactaagtgattaccaagaggagcagctacgcgttcgcgttgtttatcgttgagtccgtcaagtaattcagaaatatccatcataaactatctttaatctgtttaaatttacagttattatagtcccatctatcttgtgaaacaataagatttgtgagtatatcaaaagtagggtagaacattttaagaataatattaagcgggattctcctatatccttaaactcaacatcaaaaccatatgctttgaaagctatttttatactatttataaacaaacttttaattcgtttacctctcattcctaaaatgcaaggtttctcatttttccaaaaatacccatgatgacaataatagcataggaatgttgtttaatgacttaatcaatacttgatttgctaggattcctgtaatgattttataaacatttgcttttctttctacttgcacgccattttacgcatagtcggtgattttgtccgaattaagttttaggttaaaaagttactcaaattcaatgttattcataattaatacaaataagaaagggtgagatatggtacaaaattccaaaaaatggttagcacaaaggaatgggagaagtgtgctatccaagtttcattatgatcattctctaaagtagaaaacgtcatatactaaattatatactgatcaaaaaataatatttccttctattactcaataccaatcaatttatgtgtttgtaaacttagctgccatttaggtttatttgaacgttgattcaattgaccaagtaaagtgatagtctcaagtaaattcattttcccatcaatttcacaaggtgaaagatagtaattctttgcttttattttttgctcgatcaattcacaaaatgatggcatattactgtccattacaatacgtacttcatttgcaaatggaatgcaacgcttttcatacttatgagcataaaggctcttaggactcgtcgcaatataatctatttgtgcaggaattgcttttagaccattggtttcaattgcaagaaaatagccatctgatttaaattgctcaagtaagtattcaatttttggtacaattgttggctcaccacctgtgatgataatattctttgacgaaaatgaccgcactttttctagaatttgtgatacagaccagcgtttaaaattattataaggtgtatcacaccaaggacagtctagattgcatttaccaaatcgtacaaaaacacttggcattcccgtattgaagccctccccttgcagactttcaaaaatttcgactatgttaaagttcggttcaaaatcatgatatttttccatcaacatttactcctgatactcgcaaaatgaagttggggtttcccataaacgaatggatgatatggacagttgttcatcatgttttaaacgattaaaaataaaacgagctatttcttctgccgtagttctaaagggaacaccaaaagtttttgagtttaacttttgcaatagagtggcaatttggctttctcgctcattggtttgatcataaataaaggcgtgatccatcggatctaaaataacttttttcacaatagactttagatctgaaaaatcaatgaccattgctttttttgcacctgatttatataagtcacccgaaatttcaacttgtaatttatatgtgtgtccatgtaaattttgacatttcccatcatgtccatctaataaatgtgccatgtcaaagctaaattctttggaaattttaaacattttttctacctttttgagtcaaatatttctttaaacctttattgcgtaaaatacagcttgggcattttctgcatccaccttcgatgccttcatagcaagtgtgagtatgtttttgtacataatctaatacgcctaaattcatcagcaagttgccaagtttgggctttagtgagatacattaatggtgttttggatattggaattggataatccatagctaaatttaatgtgacattcattgacttgataaacacatctcggcaatctggataaccgctgaaatctgtttcacatacgccagtgataatatcttgaatgccttggcctttcgcataaatcgctgcataaagtaaaaatagggcattgcgaccatcaacaaaagtgtttggcaattcattctctttttgctcaatatgcgcttgttcatccattaatgcattatgcgtgatagctttcataacagatgtatcaatcaaggtttgtttaatgccgagatcttgcgcaatagtgcgcgccttttctaactcaatagcatgacgctgcccatattgaaaggtaatggcttctatgttttctttgccgtattcagcaatagcttggaataaacaagtcgtggagtcttgtccacctgaaaagatgacaatcgctttacgatcgtggtttggattgaaaatattcatattttacctagttttttattgtaggaggtttgcgaactacggggggtattctagtggggaagttctattttagcaagacaagtgaaatatttcgttggatgtgaagtcgttgtgctacaattcgcaggtttttaatttagcaaaaaggtttacttatgaaaaaatggttgttgattatcgcaggcgcgttgattatttcagcttgcgcaaataaggatgtgtattttaacggtgcagaaggttcgcattcaggtgttaaatttgataaagattctcgccaatggggattaaatcaataaaaaagtgcggttgatttttaaccgcactttcgttttttggtagaaattattctactttcacaatccagccttcaggtgcttcgatatcaccgaattgaatgcctgtnaattcatcataaagacgacgggtaacagggcctacttcagtttctgaatcgaatacgtggaattttccgttgtgttgaatgccgcccactggggtaatcaccgccgctgtaccgcacgcaccagcttctacgaattgatcgagttgatcgatatacacatcgccttcaatagcttccatacctaaacgctcttttgcgatatgtaaaagagagtatttagtgatacttggtaaaatagattctgattttggtgtgatgaatttattgtcttttgtgatcccaaagaagtttgccgcaccgacttcttcaattttggtgtgagtttttggatctaaatagattgcatccgcaaatttacgttctggcgtaccttgttctgcggctaattcgtgtggaagtaagcttgctgcgtagttcccacccactttcacaccaccagtgcccattggtgcagcacggtcataatcggtcgtgataaagtttgatggagccaaaccacctttgaagtaagcacccactgggcaacaaaaaacagagaaaataaactctggtgccgttttcacgccgatattttcgcccacgccaattaagaatggacgtaagtataaggttgcaccagaaccgtaaggacccaaccaatcttggttagctttaaccacttctttacatgcacgcacgaataattcagttggtacgcgtggcattaaaagacggtctgcggtacgttgcatacgctctgcatttgcttgcgggcggaataagttgattgaaccatctttgcaacggtaagcctttaatccttcaaaacattgctgaccgtagtgaagagcggttgaaccttcgtgaatatgtaatgtgctatctgtagtgagttttccttcgtcccatttgccatctttccagtgagcgatgaagcggtaatctgttttaatataactaaaaccaaggttattccagtctaagtctttcattttacttccttaatattattttttgaatgaaatttcgcttaatctacaccattcctgaagtgatttaaataataaattctcgaaatgatgcaatttttagccaactaaaaaggaataatgaaattttggaaacagggcaggaaataacgatatagttatgctaaaatcgggatgaaaaaaacgccactcaatgagagcagcgtttaaccaaatcggtttaataatatacaggaagtaaatgagtaacaaattgttactcaagttcggtttcccgaactatatgcaaacacaacatcatacttaagtctgaaactcattaactagtaaggaattaccaatcattaagtatggttgtattgtaaggaaaagggtaggaaaggacaagtgacgttttttnatttgaggtattagaaaaactaatttgaaataaatcttgtccattatagacgaaaattttataaatggaaatncttatgtataancgtttgccaccattgaattcactaaaatcttttgagtcggctgctcgttatttaagttttactaaagcagcagatgagctttgtgttacacaggcggcggttagtcatcaaattaaattattagaagantttttagggattgatttatttaagcgaaagantcgttctttagaattaacggagcttggtaaagcttattttgttgatattaataaaattctgcgtcgcttaaatgaagcaacagagcgattattaacgttaaaaacggatccgcatttaaatattagcgtgccacaaacttttggtatccaatggttagtgccacatttaagtgaatttaatcagctttatccgcaaattgaggttcgtttaacaggcgtggatcaagatgaaggtttgttaaataaagaaattgatcttgccatttattatggtttgggaaattggcagaatcttcaagtagatcgtctttgcgaagaaaatttattgattttagcctcacctgaattgctagcagaaaatccaattattcagcctgaagatttaaaaaaacacacattaattcacattcatacctgtgataattggcaagcgatggcaaatcatttacagttagatgatttaaatattcagcaaggaccgttatttagccatacatttatggcgttacaggcggctattcacgggcaaggcattgtattagctaatcgcttattagccttgcaagaaattgaaaatggatcattgcaagcagtgttgccgactaatttgcctgatccaaaatcattttatgtggtcaatcatcttgatcgccttgatgaccaaaaaattcaagcattccgtcagtggattattaactcaattaaacaagaagaaaatgaataaactcgcattatattgtcgcccaggttttgagaaagaagtcgccgcagagattaccgatcaagcaagtcatttaggtgtatttggttttgctcgagtgcaagataattcgggctacgtgatttttgaatgttatcaacctgatgaggcagatcgccttgcccgagacattccttttaatcgtttgatttttgctcgtcagatgatggttatttccgatttattggaagatttagatcctgctgatcgtattagtcccatcgtggtggcgtttgaagaattatcacaacaagttaattttgctcaatctagcgagctttttgtagaaactgcagatacaaatgaagcgaaggagctttccactttttgtcgtaaatttaccgtgcctttacgtcaggcattgaaaaaacaaggttggctttcggcaaaggcgagtcaaaagtgcggtcaatttttacattgtttttttgtaaaaccgaattgctgttatgtgggatattcttatgtggataatcattcctcccattttatgggaatccctcgtttaaaatttcctgcagatgcgccgagtcgctccacgttaaaactagaagaagctattttgacttttattccgcgtaaagaagagaataaacgtttaaatgaaaatatgattggcgttgatttaggggcttgccctggtggttggacgtatcaattagttaaacgcggtttatttgtttatgctgttgatcacggaaaaatggcggcgagtttgcatgatacggggcgcattgaacattgcgcggaagatggttttaaatttcagcctcccaaaaggaaaaaagtagattggttagtctgtgatatggtggaacaaccaagtcgtatttctttattgattggtaaatggttgttgaatggttggtgccgagaaaccatcttcaatttaaaattacccatgaaaaaacgttatcaagaagtgatattatgtttagaaaacttggctgttatgttggctgagcagaatttaaattttgatatccaagcaaaacatttatatcacgatcgtgaagaaatcacggttcatatagcattaaaaccttgagtgaactgttttcataaccaaaaaggacgtcgcgaatgaatttacacgaataccaagcaaaacaactatttgagcattatggattacccgtaaaaaatggggcagtctgtcaatctgttgaggatgtcgatttggtactggctcaactttcaggcggtaagtgggcagcgaaatgccaagttcatgctggtgggcgtggtaaagcgggtggcgttaaattggtacaggatgtagaggaagcgagagcttttgcagaaaaatggctgggacaacgtttagtcacttttcaaacggataaattgggtcagccagtaaaccagatttattttgaagaaacttgcgatattgataaagaattttacttaagtgcggttgttgatcgcacctctcaaaaagtggtgtttattgcttcctctgagggtggaatgaatattgaagaagtcgtgcaaaattcaccgcacttactccataaagtaaccattgancctttatttggaggattgccttatcaaggccgtgaattggcgtttaaattagggttaagtggtacgcaaaacaaacagtttaccgatatctttatgggcttatctcgtttgtttttagaaaaagatttatctttactggaagtcaatccgcttgttctcactccacaaggcaatttggtttgtctcgatgccaaaatatctgtcgatgataacgctttatttcgccataaagatttattagcactgcaagatttaactcaaaatgatgcccgtgaagcagaagctgaaaaattccagttaaactatgtggctttagagggcgatattggttgtatggtaaacggggctgggcttgcaatgggcaccatggatattgtgaaactctatggtgggaagcctgcgaattttcttgatgtgggtggtggtgcaacgcaagagcgggttgctgaagcgttcaaaatcattttaaccgatccttccgttaaagtgattttagtgaatatttttggtggcattgttcgttgtgatttgattgctgaaggtgtgattgctgcagtaaatgaagtgggcgtgagagtgcctgtggttgtgcgattagaaggaacgaatgctgaaatgggtcgccaaattttagcggaaagcgacgttaatattcttaccgcacagagtttacaacaagccgcagaattagccgtgaatgcagcaaaaggagaacactaatggcgattttaattgataaaaataccaaagtgatttgccaaggttttactggtggacaagggacttttcattctgaacaagcattggcctacggaacgcaattagttggtggcgtatcgccaaataaaggtggaaccactcatcttggtttacctgtatttaatacagttcgtgaagctgtcgaaaatacgggggtaacagcgacagtcatttatgtgccagcatcattttgtaaagatgccataattgaagctattgatgcagggattcagttaattgtctgtattactgagggtattcctacattggatatgcttaaagtgaaacagaaattaaatgaaacgggcgtagtaatgattgggccaaattgcccaggtgtgattacgcctgatgaatgtaaaatcggcattatgcccgctcacatacataaaaaaggtaaagtggggattgtttctcgttctggaactttaacttatgaagcggtaaaacaaactacagatgaaggctttggacaatcgacttgtgtgggtatcgggggagatcctattccaggttctagttttattgatattcttgaaagatttcaacaagatcccgaaacagaagccattgtgatgattggcgagattggcggctctgcagaggaagaagcagcaatcttcattaaagataatgtcactaaaccagtggttgcgtatattgcgggtatcactgcgccaaaaggaaaacggatggggcatgcgggagccattattagcggcggaaaaggtactgcagtagaaaaaattgcagcgttagaagccgctggtgtgacctgtgtaaaaagcctcgctgaaattggtgaagccttgagaaagctattaaaatcatctaaaaattaaccgcactttagttttctaaagcgtagattggctttctacgcctttatttttatatgctcgccattataaagtgagcacaaaattgctataatcagcgcacattttttaaggaagaaacacatgagccaattttnctatatccaccctgaaaatccacaagcgcgcttgattaatcaagccgtagagattttacaaaaaggcggtgtgattgtgtatccaacggattcgggatatgccttgggctgtatgatgggcgataaacacgcaatggatcgcattgtagcaattcgtaaattgcctgaaggacataattttaccttggtgtgtagcgatttgtcggaactttcaacttatgcaagggtaaataataccgcttatcgtttgattaaaaataatacgccagggcgttatacttttattcttacagcaacgaaagaattaccgcgtcgtttaatgacatcaaaacgtaaaaccattggtttacgcgtaccagataataaaattgctttagatttgctttcagccttaggcgagccgattttatcttgttcgttaatgttgccgaatgaagaacatactacgcaatccgatcctgaagaaattcgtgatcgtttggaacatcaagtggatttaattattcatggtggatatttagggcaagagcctacaacagtggtagatttaacggaagaatcgccagtgattttacgcgaaggaagtggaagtactgctccttttatttaacttatagacgcttgtgaaagcgacctttccattattcaaggaaaacaatgaaacctagtcaaaaacaaactcaaagacaaccgcacttttccaaagattcagcaaagaaacgtgatttttcagctaaaaatgacagacgttcagtatctcgtactgctcgcatagaaacagcaaatacgaaaaaaagtgcggttaattctgacaacaaatttttatctaagccaaaagcgaaacctgttgtaagagcctcgaatcaaccgaaagcagagggcgaaaaattacagaaagttttagcgcgtgctggacaaggctctcgtcgtgaaattgaaacgatgattgccgcaggcagagtgagcgtagagggtaaaattgcgactttgggcgatcgtattgacgtacattctggcgtgaaagtgcgtattgatggtcaaatcattaatcttagccacacacaaaaagaaatttgccgtgtattaatgtattacaaacctgaaggcgaactttgtacacgtagcgacccagaagggcgcgcgaccgtgtttgatcgtttgccgcgtttaacaggctctcgttggattgcggtggggcgtttagatattaatacatcgggtttattgctttttaccactgatggcgaattagcaaatcgtttaatgcacccaagccgtgaagttgaacgtgaatattctgtgcgtgtatttggtcaagttgatgatgcgatgttagcacgtttacgtaaaggcgttcagcttgaagatggccttgccaactttaaagaaattaaatttacaggcggtgtgggtattaaccaatggtatgacgtaaccttgatggagggacgtaaccgtgaggttcgtcgtttgtgggaatcccaagggattcaagttagccgcttgattcgtattcgttatggaaatatcaaactgatgaaaggtttgcctcgtggtggctgggaagaaatggatcttgaaaacgtcaattatttacgtgaattggtgggattacctgctgagactgaaacgaaattagatgtaaaacaggctagtcgtcgtccaaaatctgggcaaattcgtaaagcggtaaaacgttattcggagatgnacaaacgttatnaaaaataaggacttttttatgaaaatgcatcaattgcgttatatcgttgagattgtaaaccaaaatttgaatgtcacagaagctgcaaatgcactttacacatcacagccgggtatcagtaaacaagttcgcctattagaagatgaattaggtctggaaatttttgagcgtcatggcaagcatataaaatcaattacaccagcagggaaaaagattatctcaattgcacgcgagttacttgttaaagcgcaaggtatccgtgccgttgccgatgaatatactcggccaaatcacggtgtattacgtattgcgacgacaaatactcaggctcgttatatgctgccaagcgtgattgaacgtttttctaaaaaatatcctgatgtgagcttgcatattcatcaaggttcgccaacacaaattcacgatgctttaatgtcaggtgaagtggatttggcaattaccactgaagcaccttatttatttgatgatttagttcagattccatgctattggtggaatcgtgccgtgattgtttcgccagaacatccgcttgccaaagtgaaagaactgaccattgaggaattaggcaaatacccacttgtgacttacacgtttggttttacgggtgtttctgatttagattacgcatttaatagtgcaggcattttaccaaatatagtttttacggctaccgatgctgatgttattaaaacttatgtgcgcttgggtttaggggtgggcattatggcatctatggcacatacggcattagatacggatcttgtgctaattgatgcaagccatttgttccgcccgagtatgacgaatattgcatttaaacatagcacgttcttacgtaattatatgtacgatttcatggaatatttttcaccgcacttaactcgtagtgtcgtagaaaaagccgagcgtttgcgagataacaattcagtgaaaaaattatttgaaggcattgaattggaaacaaaataacaatgtccaaatgaagtgcggttgaaatttaataagaattttaatcgcacttaaaagattaaaacagatcgtgatatttcactaaatccttacgctgaatagcaaatacgcctagtccgccatttttaagttctacccattcaaatggtacatctggatattgctcaattaagctaatcatactattacccacttcacacaccaacacgccattttcggttaagtaatctggtgcttgttttaaaatttgtttggtaatgtttaagccatcactgccagaacctaaggctaactctggttcaaaatggaattcttctggcatatcggcgagatcttcttcatccacataaggtggattggtcacgataagatcgtatttttgtcccaaaatattttcaaataagtttgattgaatcgggaatacacgatgctctaattgatggcgtgaaatattgatctccgcgacattaagtgcatcaaccgataaatctaccgcatctacttccgcattcgggaaagcataagcacaagcaatggcaatacaaccgctgcctgtgcatagatcgagaatatgatttggttcttgtgaaattaaatcttcaaatcgatcttgaattaaagcactaattggagaacgtggaataatggttcgttcatcgacataaaattcgtgaccgcagaaccaagcactatttgttaaatatgccacaggtacgcgttgttcgattcgggttaatacaagttgaactaaggtttctttttcagatggggttaatcgactgttaaataattcggtaggtaaatcaatgggtaaatgtaagctacttaaaacgagttgcaggctttcatcccaaggattatcgtgcccttgcccgaagtaaatatcagatcgattgagaatgctatacgtccaacgcagaaaatcttggatggtttgcagttcgtttgcaacattatcttccaagatagttgcaactaattcttggttatgtgaagtttccatcgcatttctccataaaagtgagtagaaaagttagcataaaattaggtatgaaaatttggcgtagttataccacagatgagaatgtagaactatgatatgatacgcaaaatttgaaaattaatgagaaaaaaatgcaagacgaatttgatttattccgcacggaaaccaaaggcattaagccaattaaacaagatacttttgtggccccccgccaaaaacgtgatcagaaaaaaatagaattgaaagaattacgagcgaaagaagatacattgttctatttttctgatgaatatgagccattactgaatgacaatgatggtgttgtgaaatatttacgtgatggggaagattcccatttattaaaacaacttcgtcgtggagatttttcgccagaattgtttttagatttacacggtttaacccgtgaacaagctaagcaagaattagctgcacttttactggcttgtgaaaatgagcatgttgattgtgccagcattatgacgggctatggcacctttacattgaaaaaacaaattccacgttggctagtacaacatcctaaagtgcgggcattacatcaagcaccaagggagtggggcggtgaagctgcaattttgattttagtcgatttgtaaaaaacgttataaaaaataccgcacttttactgctagggcaaagtgcggtattttcttttatgtttttacttgaattattgtgttgcttgaattgcggttaaggcaattgtgtacacaatatcatcaactaaggcaccacgagataagtcattgactggtttgcgcataccttgaagcattgggccaatagacactaaatctgcagaacgttgtactgctttgtaagtcgtgttacccgtatttaagtcagggaatacaaataccgttgccttacctgctactggtgaatttggtgctttagagcgagccacatcttccatcactgccgcatcgtattgtaatgggccatcgattaataaatcagggcgtttttctttcgcaatacgagttgcttctttcactttttctacatcagcaccgctaccagatgtacctgttgagtaagaaatcatcgcgacttttggatcaataccaaatgctttagcagaatccgcagattgaattgcaatttcagcaagttgttctgcagttggatctgggtttaccgcacagtcaccataaacaagcacttgatctggtaataacataaagaagatcgaagaaacaatagaactacctggtgcagttttgatgatttgcattggtgggcgaatggtgtttgcagtggtgtggacagcgccagatactaaaccatctacttcatttgcttctaacatcatggtaccaagtactacggtgtcttctaattgttcacgagccgcagtttcggtcataccttttgctttacgtaattcaactaaacgatcaacatagttttcacgaacgtcagcaggattgatgattgtaatgcctttacctaatttaacaccttgtgcttctgcaactcgttgaacggatgcaggatctgctaaaagcacacattccgcaatgccacgttctgcacaaagtacggctgctttgattgtacgaggttcatcgccttcaggaagcacaatacgttttttcgccgcacgagcaagttcagttaattggaaacggaatgcaggtggggataagcgaggtaaacggctggaatctgcaactaaattattgataaagtcagcattaaagtgctggctaatgtattgtttaatattttcaatacgttctttgtcatcaacaggcacttcaagattaaaactttgtaaacttaatgcagtttgccaagtattgccttcaatacggaagatcggtaatttcgctttttcaaaagttggacggcaaagtttattaatttgagcatcaattttgtagccgcctgttaataaaataccgccgatttcaataccatttgatgctgcaagagcggctgctacaagcacatctggacgatctgctgaagcgactaataagctgcctgcacggaaatgttctaccatatttggtaaacttcttgcacagaaagtgataccacgaatacggcgattgatttctccttcattaatgattgatgcacctaaatgtttgactaagtcgattgctcgtgtcgcgattaaatttgcattccaaggcacacaagctaataacttgatggcactacctgcaaataacttgtttacttctgtttcgctaatatgattgtgttggaatgaatcaaaaatttcagcaagatctggacgagtacgacctgattcatcaacaggtgcattgaatttgtttacaacaacacctaaaagatttggattgtttttaccaccaaatagagaggctgcagcttctacgcgatcttttaattcggttggcgtttcagttgcaggtgctgcaactaatacaatttccgcatctaatgcttgtgcaatttcatagttgatactgtttgcgtaaccgtgttttcttgtaggtattaagccttcaactacaacgatgtcattatttttggttaattgttggtggttagctacaattttttctaacaatacgtcagactgattttgaccaattaatgattctgccacgcttaacataaaaggttcggcagtttcaaggctagtgctagtgcgaataatagaagttgtgcgatccaatttatcttcgccagtgcttggttgagaaactggtttcataaaagcaacttttgtgcctttttgttcgagagagtggattaatccaagactaatgctagttaaacccacgcctgtacttacagggataagaataatcgtgcgagacatagttaaaccttaatatgtatattttataaataaaaactgccgaaaaattcggcagcttgttgttaaattagaaacaaagttttgcggtatcttgtgcgataaccaattcttcgttagttggaagaacaattgctttaaatgcggaatcatcagtggtgattacaccatctttaccaaaacgtgtggcaagatttcgttcgttatcgattttaatgccgaataattttaagtgatttaaggctaattcacgaacgtgcgctgagttttcgccaataccaccagtgaatgcaattgcatctaagtgatcatcgcccaacacagccatataagcaccaatgtatttcgctaaacgatagctataaacatttaaagcacgtcttgtttctggtttagattcatcatcgtagttatcttcagcataacggcagtcgcttgttacttcagttaaacctaaaagacccgattttttcactaaagtctcttcgatttgatccatagacatacctagtgttttgtataggtagaatacgattgcagggtcaatatcgccacaacgcgtacccattactaaaccttctagcggagttaagcccattgaagtatcaatacattgaccgttacgcacaacagaaacagaaccaccattacctaagtgacaaataatagcatttacttgatctgcaggtttgcctacatatttagcgacttcacgagaaacgaagtagtgacttgtgccgtgtgcaccatagcgacgtacgccgtgttctttatataaagagtatggaagggcataaaggaaggcttcttcaggcatagtttggtggaatgctgtatcaaaaactaccacgtttttatcttttaagtgtgggaatgccttgaatgcttcgcgaataccaattaagtgagcagggttgtgaagtggcgcaaattgtgcagcatcttcaattcctttaacaacttcatctgttacgatgacagattgagtgtatttttcgccaccgtgaacgatacgatgaccaattgccgcgatagaatttttaagctcatcattcagaatgttagatgcgataaaattaagtgcttcagtatgcgctgcgcctgcgcctaaatctgcgttacctttctctccattgagtttccatttgatacgtgcttctggtaagaaaaatgcttcggctaagccagataatttttcttcccctgttgctggatcaagaattgcaaatttgagtgaagaactaccacagttaaggataagaacaagttttgacataggaaccctatatttgattgaggttaatagaaatccatcatctaagatggtttgaaaaatcagacatagaatacaccttttgatgaataaaataaattcatcggtaaggaaaaaatacaaactttatcgtattttttgaaaaattaaactatttttactaaaaatagacttaaaatagcgtatgataagtgcggtcaatttttgaggtgtttttatggcatttttttccatttttaaacaggggcaaatttatcttaatacttggccgctggaggcgaagttaggcattattttccctgaaaaccgtattatgaaagccacgagttttgcacaaaaatttatgccttttgttgctgtgtttgcaattctatggcagcagttttatgcaaaaaatgatttgatggcattttctatcgcaattttgaccgcactttttgccttgcttattccttttcaaggtctttattggcttggtaagcgtgccaatacgccgttagaaaatcaaagtgcggtatggttttatgatatttgcgaacgtttaaaacaactacatgaacccttgccttttgtgcaagaaaaaccgacataccaacatttagcggaagtcttaaagaaagctcaaagtaaattggaacgtgctttttggcaggaaatttagtttacgcaaacgttttctttttggctttatttttgtagaatagctcggtcgttttaaacggccgtttttcattgagagattttttaatgatcgattacattattattggcattatcgctttttccattcttgttagtttattacgcggttttgttcgcgaagtgctttcactcggtagctggattgtggcatttattgtagcaagtcagttctatccttatcttgctgcttatcttacgcaaattgaatcaatgtatattcgtaatggaactgcaatcgccattttgtttgttctgactttaattgtgggtgccatagtaaattatgtgattagtcaattagtggataagacgggtttaagcggcactgatcgcgtattaggtgcagctttcggtttagtgcgcggtgcgctgattgtggctgcgttgttattttttatggatacttttaccaattttgaacaaactgattggtggaaagaatctcaattaattccgcactttggttttattattgaatggttctttcaacaacttcaggcgagttcaagttttttaactccaacgcttaatcaataaggaacacaaaatgtgtggtattgtcggtattgttagccaaagtccggttaatgaatctatttatgcagcattaacccttttgcaacatcgtggacaagatgcggcaggtattgtaacggttgatgatgaaaaccgttttcgcttacgtaaagctaatggtttagtcagtgatgtgtttcatcaagaacatatgctacgattgcaaggaaatgctggattggggcatgttcgctatcctacagcggggagttctagcgtctcagaggcacagcctttttatgtgaattctccctatggtgtcactttagtgcataacggcaacttaaccaactcagtggagttaaaagaaaaggtctttaaaactgctcgccgccatgtaaacactaattcagattccgaacttcttcttaatattctcgccaatcacctcgatcacattcctcaagatcacctcgatccacaagatattttctatgctgttcgtaaaactcacaaggatgttcgcggtgcttatgcttgtttagcgatgattattgggcatggcatggttgcgtttcgtgatccttttggcattcgtcctttggtgttgggtaaacgcgaggaaaatggcaaaaccgattatatgtttgcgtctgaaacagtggctttagatattgtaggtttcgaatttgtgcgtgatattgctgcaggcgaagctgtttatgtgacgtttgatggcgagctttattcacaacaatgtgctgaaagtgcggtgttaaatccttgtatttttgagtatgtttattttgcacgcccagattcaacgattgatggcgtctctgtttatgctgcgcgtgttcacatgggcgaaaaacttggacaaaaaattgcaaaagaatgggctgatgaaattgataatattgatgtggtgattcccgttcctgaaacttcaacagatattgcgttacaaatagctcgtgtactagggaagccttatcgccaaggatttgtgaaaaatcgctatgttggccgtacctttattatgccaggacaagcacagcgtattagttcggttcgtcgtaaattgaataccattaaagctgaatttaaagataaaaacgtgttattggtagacgattctattgttcgtggcacaacctctgagcaaattgttgaaatggctcgctcagctggtgcgaagaaaatttacttcgcctcggctgctccagaaattcgttatccgaatgtatatggtattgatatgccgagtcgcgatgaactgatcgcttatggacgaaatgttgatgaaattgcagaattaattggcgtagataaattaattttccaagatctgaccgcacttactgaatctgttcaattggaaaacccagccattcaaggttttgattgttctgttttcacaggcgaatatattacaggcgatattagccctgaatatttagagaaaatcgcaactcaacgcaatgataacgcaaagaagaaacgagaaaaacaagcatccaatcttgaaatttacaatgaacaataaatgctaggcatttagagggataaaaatcatcgtattaaaagtgcggtgatttttttatttgttttttaggatgtcttctagatagttttcgcaatcagcatattgaaattggaatccagcgttaagtaatttttcaggtacaacattttgactttcgagtaatagatttgctcgctcgccaagaataaaatgtaatagccattttggaatggttgcaaaggcaggacgttttaatagttgagctaaagtgcggttaaatttatgctgttttatagacttgggggcagcgaagttaaacgctcctctgcattctgaatgatcgagtaaaaataaaatgccgtttaccatatcttccaaagcaatccaagggaaatattgctctcccttgcccagtttaccgccaagtccccatttgtagaaaggcaatattttagcaagtgcgccaccttttgtagaaaagaccatgcctgttctaatcaaacaaaccctcccattagcttgttgcgcaatattttcccaatcttggcataattgtgcagtgaaggtttttgctgttttgcttgtttcggtaattttttgttcgtcttgatcgccgtaaattcctgttgctgaacctgatataaaaattgggtgttgctgatattgattaatgaattcaaccagttgagtggtgaggcttaaacgactttctcgtaaaatagatttctggtttttcgaccaaactttatgaaaaattggctcgccagcaagattgatgatggcatcaaactgttcttgtgaattaagttgggaaagtgcggtaataaatttgatgtttttgtgctttgagagagtgtgcggcgaacttgagcgcgttaagatcgtcacttgttcattgcgtaaacagagtcgttcgacaagtgctttgccgataagtcctgttcctcccgttaatagaatattcattacaatgtgttttcaaataaacgttggatattttgcaataattcgtcgataggtttattgtttgtgggcgtgacaaaaatagtatcatcgcctgcgatagtacctaaaatgccttctgattttccaatggaatcaagtaatcgtgcgattaattgagcagcaccgggcgtcgtttttattacgattaacatcgcattgtgatcaacatctaagacaagattttttaatgggctactggtattgggaacacttaattcatttggtaagcaatagaccatttccattttggtattacgggtgcgaactgcgccaaatttgctgagcattcttgatatttttgattgattaataccagtaaagccttgtttttttaaggcatcgacaatttcactttgagaaccaaagcgttcttggttgagtaattctttaaaagcgcgagttaaattctcagtcatctttatttttcaatagtcaaaatttgcataagaattgcataaaaattcactttcatcaactgaaatatgaataagaacaaagagaagaaaatatttatctcagaaatgtgaactagatcatagaatgatatttctctatttgtaattgtaagatgaacattttaaaatcagtctgttttaaattaactaacacataaggagtatttatgaaagttgctgtattaggtgccgcaggtggtattggtcaagcattagcgttattactaaaacttcagttgccagcaggtaccgacttatcattgtatgatattgcccctgttaccccaggtgttgcagtggatgtgagccatattccaacggcagtgaatgtgaaaggtttttctggtgaagatccaactccagcacttgaaggtgcggatgttgtattaatttctgctggtgttgcacgtaaacctggtatggatcgttcagatttattcaatattaatgcaggtatcgtgcgtggtttaattgaaaaagtcgcggttacttgtccgaaagcatgcgttggtatcatcactaacccagtaaatactaccgttgcgattgcggctgaagtgctgaaaaaagcaggcgtttacgacaaacgtaaattatttggtgtgacaactttagacgtgttgcgttctgaaacctttgtggctgaattaaaaggtttaaatgtttctcgtacaagcgttcctgttattggtggtcactctggtgtgactattcttccattactttctcaagttcaatatgcaaaatggaatgaagatgaaatcgaaccattaacaaaacgtatccaaaatgcaggtacagaagtgctcaatgcaaaagcgggtggcggttctgcaaccctttcaatggcgcaagctgcagcacgttttgcgcgttctttagtgaaaggattaagtggcgagacagtggttgaatgtacttatgttgaaggtgatggaaaatatgctcgtttcttctctcagccagttcgtttaggtaaagaaggtgtagaagaaattttaccaattggtccattaagcaattttgaacaacaagccttagaaaatatgttgccaactttacgtgcagatattgaattaggcgaaaaatttattaatggttaatcattaaaaaataagggggagttagctctctttttatgtttcgataaaaaagccaccaaatggtggcttttgtttatatctttattatttctgacgcattgcagggaataagataacatcacgaattgacggtgcatttgcataaagcatcgctagacggtcgatacctaaaccttccccagctgttggtggtaagccgtgttctagtgcaacaacaaagtcttcatctttaaacatcgcttcatcatcgcccgcttctttcgcagccacttgtgcatcaaagcgttcattttgatcttccgcgtcatttaattctgagaaaccgttaccaatttcacgtccgccgatgaataattcaaaacggtcagtcacttcagggttttcatcattacgacgtgcaagtggcgaaatttccgcaggtgagccattaagaaaggttggttgaattaagtgatgttcagccacttcttcaaagattgcattgacaatgctgcctaaaccccaagatttttgtacttcaatacctaagcgttcagcagttgcttttgcacgatcgaagtcataaagatcttcttttacgatacctttatctgcaccatatttaatggttgcatcatgtaatgtaatacgctcaaatggtttgccgaagtcaaattctaaatcaccgtatttcacaatggttgtaccaagaatatcaatcgctaatttacgaagaagttcttcggtgttatccattaaatcatggtagtccgcatatgcttgatagtattcaagcatagtaaattctggattatgacgaacagaaaccccttcattacggaagttacggtttaattcaaatactcgttcaaacccaccaacgactaagcgttttaaataaagttcaggtgcgatacgtaaatacatatccacatctaatgcattgtgatgagtcacgaaaggacgcgcagatgcaccgcctggaatcacttgtaacattggcgtttccacttccataaagcctttagaaatgaaatattcacgaatacccgcgacaactttagaacgaataataaaagtgcggcgagattcttcgttagaaattaaatctaaataacgttggcgataacgaacttcttggtcggttaaaccatggaatttgtctggtaatgggcgaagtgctttggttaaaagttgaacttccgtagttttaacggtgagttcatcagtttttgttttaaataaagtgcctttaatgccaacgatatcacctaaatcccaagtaccaacgtcatctttataaacaccttcaggcaaattatcgcgtgcaacataaagttggattttaccgctcatatcttgaatagtgataaaagttgctttacccattgcacggcgagtcataatacgaccagcaacttgtacttcaatgcctttttcttttaagatttccccgtcttctgcatcatattgattgtgcaaatcttgtgcgagagcatcacgacgaaacttatttggaaaggcattaccttttgcacgtaatgcggctaatttttcacgacggacgagcatttcgccattgagatctaattctttaacttcttgntctgacatattgtttaccttttttataaattaataagaaatttttattttctttgtttactttaggagctgtcgaagactaaaggaaatatattatcgaaagcccccttccgtacgttcgcgccactttccccgtaaacaggggaaggcaagaaatttctacaagcccgcttttaaactcgcttcaataaatcgatctaaatccccgtctaatacggcttgcgtattacggttttctacgccagtacgtaaatctttaatgcgtgaatcgtctaatacataagagcgaatttggcttccccaaccaatgtcagatttattatcttccattgcttgtttatccgcatttttcttttgtaattcaagctcatacaatttcgcttttaattgtttcattgcttgatctttgttcttgtgctgtgaacggtcgttttgacattgcaccacaatgccacttggcatatgggtaattcgcaccgcactttcagttttgtttacgtgctgaccacctgcccctgatgcacgataaacatcaatacgtaaatcagcaggattgatttcaatatcaatatcatcatcaatttcagggtagacaaatgctgcgctgaatgatgtgtgacgacggttattggaatcaaatggacttttacgcactaaacgatgaatccccgtttctgttcgtaaccaaccaaaagcatattcaccgctcactttaatggttgctgatttcaatccagctacatcgccgtcagagacttccatcagttctgttttaaaacctttgctttcagcccaacggagatacatacggagcaacatttctgtccaatcttgagcttcggtgccgccagaacctgcttgtaggtccacatagcaatcgcaagcatcatgttcgccactaaacattcgacggaactctaatttttcgagttgttgttcgagttcatctaattccgctaccgcttcattgaaggtgtcttcatcttctgcttcaatggcaagttctaataatccatcaacgtcttctaaaccttgttctaaatttttgatggtatttacaacttgttctaaagaaacgcgttctttaccaagcgcttgggctttatctggatcattccaaacatctggctgttctaattccccattgacttcttctaaacgctcaactttggcatcgaagtcaaagatacccccgaagcactgaagtgcggtcagataaatcgatgattttattttttacaggattgatttcaaacataataaattcactgtgtgataaagtgtggaattatatgctattttctgatttttggatagtttgaccttgcagaaattagcaatctctctataattttaaactttctcactcaagctaatttaggaacaaaaaatgaagaaaatttttaccgcacttttgtgcgtggctgcggctaatgcaatggcagatgatgcggcaattaaacgcaaattacagtcttttaatatatcaaatattgttattaaatcttcgccgatttcaggcattaaaacggctgttacggatcaaggtatactctatgtgagcgaagatggaaaatatctttttgaaggtaaactttatgaactcacaaataatggccctgttgatgtcgcaggtaaaattttagtggataaacttaattcttataaagacgagatgattgtttatcctgcgaaaaatgaaaaacacgtagtaacagtatttatggatattacctgtcattattgccatttgttacatcagcaattaaaagaatataatgatcttggcattaccgtacgttatttagctttccctcgtgcaggtatgaataatcaaacggcgaaacaaatggaagcgatttggacggcgaaagatcccgtttttgctttaaatgaagcagaaaaaggcaatttaccaaaagaagttaaaacgccaaatatcgtgaaaaaacattatgaattaggtattcaatttggtgtacgaggaacaccaagtattgttacctcaactggtgagcttattggcggttatttaaaacccgctgatttattaagagcacttgaagaaacggcacaataattttataatgaaaaacaaggggcagttgcctaccccttgtgttttaatagtcggtaatgcttaatatgctggggagcttaaaagcattaacaacccanaaattatgatataaatacataatttaggcatcattaaaatccttagctgacacaatagttagactaatggtcagtaggtttaatccctgtcagcattcagggttaaaagccctgaccaacaggaaaaagtatagataaaagagctgttgatttcaacagctttttgcttttaggtatgaattaatatccagtgaaaaaacttatcaaacgccgtgaaattccaattggaaattctgtttcaaaccatcccttattagatcgactttatcgcgctcgtcatattcaaaacaccaaagaattagaccgcactttgaaatcaatgctcaatccaaatcagttatatggcattgagcaagcggtaaatttattagtggaagcctatcaaccacagcaaaaaattgtgattgttggggattttgatgctgacggtgcaaccagcacagcattgagtgtgctggctttaagacaacttggcttttctgatgtggattaccttgtgccaaatcgatttgaacaaggttatggtttgagtattcccgtggctgaaatggcaattgaaaagggcgttcagcttttaatgacggtggataacggcgtttcatcttttgacggtgtggcatttttgaaagaaaaaggcattcgagttttagttacggatcatcatttaccgcccgaaactttgccgccagccgatgcgattgttaatcctaatttaagtcagtgtggttttccttcaaaatccttagcgggcgttggtgtggcgttttatttgatgttagccgtacgagcaaaatttcgtgaactcggtatttttacggcagaaacacaacctaattttactgatttgctcgatctggtggcactaggcactatagctgatgttgttcctttggatcaaaataatcgtatccttgcttatcaaggtttaatgcgtatccgtgctagacactgccgtcttggtattattgcgttggcagaagtggctaaccgtaatgtagagcagtttacttcaagtgatctcggtttttgtattggaccgcgtttaaatgcggcagggcgtttagataatatgtcgattggggtagaacttttgctggcgaacgaaatgtcaaaagccagagaattagctttagatctcgatcagcttaaccaaactcgtaaagaaattgaagcaggtatgaagcttgaggcaataaaaatttgtcaaaatcttaccgcactttttaaagagttaccctatggtattacgctttatcaaccagattggcatcagggcgtattaggcattgtgtcatcaaggattaaggatcaatatcatcgtccagtgattgcctttgcacaagatagtgagggaattttgaaaggttccgcgcgttctattgaaggtttacatatgcgtgatgttctggagcgtattcattcgcaacatcctaatatgattttaaaatttggcggacacgcaatggcggcaggcttgagtattcgcgaagaacattttgcggatttccaacatatttttaatcaaaccgttgccgattggcttgatgaagaacatctacaaggcgtaatttggacagatggcgaactgaattcaaatgaatttaatcttgaaacggcagagctgataaaatcggtaggcacttgggggcaagggtttcctgagccttgctttgatggcgaatttaaaattttagaccagcgcgcaattgggcaaaataaaaatcatctaaaaatgttgctagagccgaaacaaggcggggttttattagatgcgattgcatttaatattaatacaagattgtatcctgatctttcaattaaacaggctcgtttagcctataaattagagattaacgaatttcgtggcaatcgtagcctacaattattggtagattatattgagccgatagatgagtgatagaatgaaattaaaagggttattggcattttgtttgctttttttatcgtcgtttgttttagcagaagtcaatcagaaagaattttcagtgcaaaattctccgcacttgccatcacgggacacaatttattttgaagacgggcgtgattatttttcttataaagaacctattgaacaagcgtctcgaaccgataaaaaaatccgcattcaattcttttttgattacgattgtcgagtatgttcttcagcgcaggatattttagagctttatagccaaatacgcacatataaagttgcgttggaacaatatcctattgcaactgccgataaccagtttagcgcacgcattttttatactttgcaagcattaagtgcgggggaattatctaatgttttattatttgaaacttcagaaaaatcccgttatacagaattgtctacatcaaataaaattcagcaatgggcggaagaacaagggttagataaacagttatttattcaaactgaaaattcacaaagcgtaaaagaacaaattcaaaatgcgattgaattgacggaagaatatggtgtgtttacctatccttacgttgttattgggggaaaatatgtactcactgcgagtacgctttataacgatgattatagcgtagcggtgttagattttttggtaaataaaatagaacaggaacaaaaacaatgaaaatcggaattgttggtgcaatggcacaagaagtcgaaattttaaaaaatttaatggctgatagaacggaaactcgagtagcaagtgcggtcatttttgaaggtaaaattaacggtaaagatgttgcattattgcaatcaggcattggaaaagtggcagctgccmttggcacgacggcgttattgcaattagccaaaccagattgtgtgatcaatactggttctgcaggaggggtagcaaaaggcttaaaagtgggggatattgtgatttctgatgaaacacgctatcacgatgcggatgtgaccgcttttggctatgaaaaagggcagttgcctgctaatctgcggcatttttatcggacaaaaaattagcagatctcgctcaagaaattgcagaaaagcaaggacaatcagtaaaacgtggtttaatttgctctggcgatagttttattaatagtgaagacaaaattgcacaaataaaagcagacttcccgaatgtgacgggggttgaaatggaagccacagcgattgcacaagtttgctatgcgtttaatgtgccttttgtggtggttcgagcaatttctgatgggggcgatggcaaagcaagtatgtcttttgaagagtttttaccattagcggcgaagcagtcttcggcattagtgttagggatgattgatagactgtagtaataatcttttaataagataataaatgctaaaattaaaggcatagctattagctatgcctttttatatgaacctattagaatttatagtttaaactcagaatataagttcttccacgtgcaaagttataaagcacggttttatctgaaccaccgcaagcagaagaatcttgcgcacattctatagaattatttaaacttgaataataacgttgcgaagccgcgtcatttccagcatctaacggatcaacataacgtttatctaatagattttgtacttccgctttaataatcaaatctttgattggttcatagctgacgtgtaaatctaaaataatcggttgttttttaatatcttccgtttttttcacggcatagtaattttcacgacgcaaggtattttttttaaagcgagatccattgatatattcttcttcaattgtcgcacgtttactttttccataataacgagctgccagacctaaggttaatttttgatcaaaccaacgtgtgccaagctctaatctgccgtagtcttttggtagcattgaaacacgagataagccataaccttgtttcaaaatgtcttcttgtgaagcattattcggacgcgggctggcatcggcataattggttggttgatttgttcgttgatatgcataagagacattcgcaaaaaaacgtcccatgtcatagttaatttctaactcgacgccgctctttttcacaataggcttataattttgatgagcaatagtatatttaaatccattactttctgcccacgtaggcatgccatctcgccaccaaacaccataaacattatggatatagtttttaataaagctacgatagcctactaattttacgcctagcacatcgtcttgagtgaagagaccttttttataagtattaaagcctagttgataggtgtcagattgttcaggttttaatgctgtgtttacccctgcattagacacttgagagaaaaacatctcttgaatattcggcattctgtgagtgcgtgaataagtaaaaaatggcataaaataatcactcagttctgcacttaatgtggcagaatgattgaatgcctttttatgccctgatttatgcaaaataggttcattaatttgttgacccgctgtattttcgtaacctacatactcaccattaaaggcataatgggtaaaattcacgctgtaatttaaatgataaatgcctttagaaagtgcggtatcaaaatacacggttttaaatttttgcttgccagaaggttgtaagattactgaacgttgtggtaataaactttttgtgccagaatatcgccctcttttactgtgtgaatataagccttgatcatgtgaagcatcgttataaaacaaacttaattcttctggaaaacggtttttactgtattcattggtaaaatagttaaaacctaatgtggtttttaaatcaatttcttttggcagtaagaaagtatggctgttgtttatatcaacaatatttgcgacatttttagtgataagtttatctgccacttgccagccagcaaaaaaaccgcctttaggataaatagtttttccaatgttatgtgcagccattaaattaagatcaagatagctgttattattgaagttataattgacttggtaattacggttttcaattttgcgagaaccaattttattatccaacgtgcgtaattgcgcccctaaattttggtgatcatcgccatattcaaattttaataaatggctacgagaacgagattgcaaactacccggctcaatcggtgcaacactatattgntctttattacgttcaaatgatttgtcagtttcttcaattccatcattacctttttggagcttttcaatatccttaggtttttttccatttgttaataattcttgtagaatttctcttctagtctttgcagcagatccaatacgataataactacaatcaccatttttctgataatctggtttgttacaagaccaatgttttttgcttaaatcaggtgtccattgcccttcaggatttaaaatataacccgcattacgaaaataagcttctttttctttcgcgagaatatcctgccctaatgatgctaatcgttctccgccaccgatacggtaatcttgagatacttcacgttggctataaccatacaccacgcctacatagccaccattatcaagccattttctgccagcagccattgtcataaaattggatttagtggcattactccctgtcattcctttcagaataatgccaaatggtttgtcatcggtaataacatcattaacgcctaatgttctaaaattagcactgcctgctaacgcatttataccgcttgctcctgaaaagttgcttttattaacatctacacctgcaataaaattaggatcgattgccgcaccaaattgagaacttccgcctgattgacctgagtctaaggctgtagaatagaaggtctgtgttacaccatcaaccatagtattgacacgacctaatccattttcgccacgaatattcacagaaacgacacccgagcctttatcttgttgagtaaatgcaccagggatacttcgaatcacttggtcaatggtttgtgtttccttaaagacattttcacgtgtacttttggctttggcttcagtgaaaggttttttatcgtttgatataactttttccactacatcaatttgtcctaatgtttcttcggcttgagcttgtgtaatcgtcataccgatcgtattaattaggccaagtgtaattaaatttaattttatagctttcttcattatagttcctatttatttttgagaaatattatgattatccattttattaagagggatctcaaggaatgatttaataaatttaatgaaaatacctaaaaaataataaaaaaattaatttttagagagaaaatacgtttagaagatagagaaaaagaaagtttggtttttgcaaaatggacaaattcattcgcaaaatcaaccgcactttaaaataggaaatgaccgcaaaagtgcggtcatttttggcgtaaattttatagattataaaataaaggtactaagaacagcgcgccaagtgcggcaatgataccgtaaatgatcataggtataatggttttcttaataattgtgccttcttggtttgaaatatttaacactgaacttaccgctacaatgttatttatacataccatattccccattgccccaccaacagattgtaaagcaagaacaagtgcgacagaaatgcctgttgtttctgcggtagaaagttgaacactaccaaatgttaggttggatacggtatttgaacctgagaaaaaggaaccaatcgcgcctaagaaagaggagaaaatagtccagttactaccagaaatttcagcaaaagttctacctataatttttaccatagaatgttcgccacccactaacattaggtttaccatcactaaggcaccaattaaggcaataaatggatttttagattgttgtaaacttgataccaaaatctgtttaacatttgaactggaaattttaaagaaaggaatcgcaattagtactgtaatgacaaatggaatcaatgcgggtacgtaaagaagtttatagcttgatgaaacatttgagccaaaaatattttttaagctaaagattaaacctttgctaatttcaaataatcctaacgaacctaatgtggttgagaaccaaatagttgcgtcattcatcattgctttgaatggtaattgatgaatacgagtcacaattaaaaatgcaataagtaaacctgtcggaaataatgctttaactacttctcctgcacttaccgcattattatcaagggtatttgttacttttgctaaaccaatattgcgattagcagcccatacagaaataaataagccgattgcccccccaacgagtgatggaaattcgtaattgacttgagcaatcaagaaataaggtactacgcaacccagtacgctaatatagataaatacgatgtttttacgaatatcatcccaatttactaagatacgaagtgctaataatgggataataagtgcagcaatggagtgtataaatgctgtaatagacccaatttctaaaatcatatcttctgataattttaaagcaccaaaaccaaaccaagttggtgtacctaccgcaccaaaggatacgggaactgagttcataataagtgccaacatcgccacttttaatggatgaaaacctaatcccactaaaataggtgcagcaattgccgctggtgtaccaaaaccacttgctccctcgatcataaaagcaaacgcccaaccaataatcattaattgtgcaacgggatttggattaatatttcctagccattttcgcataatatttgttgcgcctgaaatttcagagaaacggttaaagagaatcgcaccaaaaattactgtaataggtgtttgtaccgcaataattgcagaaacaacatttgcactaatagtgacaatatctgtattaaagtgtaaaagatgnacacccataactaatgtcgcaacccaaggtaaggcaacataagaaggtagcgcgtttctttttaccataagataaatcagtaaaacgataggaaaaatacttagaataaaagacagcataaaatatcctcagagttagattaaaagatgtgattattttntggatttatatgcaaagcatatacctattttaagaaaatgtgatcaanatctcataaaatttaacattttgnttccatttcttacatttttattactatttgtgtttagttatagcattaatagaagaatatagaatatgataaagattsstttaatgccatattaacattagcaggattaccaaattctcactataatgcgcaaaatttggagaatgaaaggataatttgtatgggaatgattattactgttgatggccctagtggtgctgggaaaggaacgctttgttatgcgttggctgaaaagttgggctatgcattgttggatagtggggcgatttatcgcgttactgcattggcagcgttgcaacgtaaaactgatctaacaaatgaaacagatttagcagaattagctcgtcatttagatattcaatttattcctcaaaatggcgaggtaagcattttgcttgcaggaatggatgtgagccgtttaattcgcacgcaagaagtggcagatgctgcgtcaaaagtagcagtctttcaaaaagtgcggtcagctttattacaacttcagcaagattttgcaaaaaatgatggattaattgcggatggcagagatatggggactgtggtattcccaaatgcacaagtaaaattatttttagatgcaagtgctgaagaacgtgcaaaaagacgctataaacagttgcaaaataaaggaataaatggtaactttgcacagattttagccgagataaaagagcgtgattttcgtgatagaaatcgtgaagttgcgccgctaaaaccagcagatgatgctttattattggatagtacaaccttgagtatcgatgaagttattgatcaggcgttagcttatattcaaaganaaggtatcagtttccgatttaactgtttgttcaaggaagaataagcatttatcctcanaccccgcattttatggattttaatgtggatgttattaacttaaattaagaagattatttatatgtcagaatcttttgctcaactttttgaagaatcattaaaagtccttgaaactcgtcaaggttcaatcgttagcggtactgtagtagctatccaaaaggctttgtgcttgttgatgcaggtttaaaatctgagtctgcaattccagttgctgaattcttaaatgcacaaggcgaacttgaaatccaagttggcgatactgtaaatgttgcattagatgcagttgaagatggtttcggtgaaactaaactttctcgtgagaaagcggttcgtcacgaatcttggattgaattagaaaaagcttacgaagaaaaagcgaccgttatcggtttaatcancggcaaagtgaaaggtggcttcacagttgagttaaacggtgttcgtgcattcttaccaggttctttagttgatactcgtccagcgcgtgaagcagatcacttacttggtaaagaattagaattcaaagtaatcaaattagatcaaaaacgtaacaacgttgttgtttctcgtcgtgcagtaattgaatctgaaaacagccaagaacgtgaacaagtattagaaaatcttgtggaaggntcagaagttaaaggtgtcgttaaaaacttaactgagtacggtgcattcgttgatcttggtggtgttgatggtttattacacatcacagatatggcttggaaacgtgttaaacacccaagtgaaatcgtaaatgttggcgatgaagttactgttaaagtattaaaattcgataaagatcgtactcgtgtatctttaggcttaaaacaattaggtcaagatccatgggcagcaattgctgaaaatcatccagtaaacagcaaattaacaggtaaagtaactaacttaactgactatggctgtttcgttgaaatcttagatggcgttgaaggtttagttcacgtttctgaaatggattggactaataaaaatatccacccatctaaagtggttagcttaggcgatactgtagaagtaatggtattagaaattgatgaagaacgtcgtcgtatttctttaggcttaaaacaatgtaaagctaacccttggactcagtttgctgatactcacaacaaaggcgataaagtaacgggtaaaatcaagtctatcactgatttcggtatcttcatcggtcttgaaggtggtatcgatggtttagttcacttatctgatatttcttggagtatttcaggcgaagaagctgttcgtcaatacaaaaaaggtgacgaagtttcagctgttgtattagctgttgatgcagtaaaagaacgtatctctttaggtattaaacaacttgaagaagatccattcaataactttgtcgcaatcaacaaaaaaggtgcggtagtatctgcaactgttgttgaagcagatgctaaaggtgctaaagttgaattagcaggtggtgttgaaggttatatccgttctgctgatttaacaagtgaagtagctgttggtgatgtcgttgaagcgaaatacactggagtagatcgtaaatctcgcattgttcacttatcagtgaaagcaaaagatcaagctgaagaagctgcggcagttgcaagtgtaaataacaaacaagaagatattgttattccaaatgcaatggctgaagcatttaaagcagctaanggtgaataattaattcacgtaatanggctgggctgatgtccagccttatttgttaggagttattgctaatatatttgtgtaatttattatcaatagatcttaatttaagtaatattaaggaagtatagacgatgactaagtcagancttatggaaaaattgtcagcaaaacagccaactttacctgcaaaagaaattgaaaatatggtaaaaggtattttagagtttatttctcaatctcttgaaaatggtgatcgtgttgaagttcgaggttttggtagcttttctttacatcatcggcaaccacgtttgggaagaaatccgaaaacaggcgattcagtaaacttatcagctaagtctgttccatattttaaagcgggtaaagaattaaaagctcgagtggatgttcaggcttaattgattaaaatttaattaaaatatttttgattaaaaagtttattttgggttacaaatattttacaggaaatgaaatgattaaatatattttaggtattgtgatctttattgctattgtgttagttgcaattaccattggtgcgaataacgatcagattattacatttaattatattgtggcagaaagtcagtttcagctttcaagcctcgttgctattttatttgggttaggtttaattcttggttggttaattactgcttttttctatattaagttaaaattaaaaaatatggcactagctcgtcaagtgaaacgtcagactttacaaatcaatgaattgacgactacgcgcgataaggtcgtttaatgatagaattactctttctattattgcctattgctgctgcctatggctggtatatggggcggcgtagtgcgaagaaagatcaagatgacataagtaataaactctcccgagattatgttacgggagtgaattttttactttccaatcaaactgataaagctgtagatttgtttttagatatgttgcaaaagcaagaaatcgaaaatgaaatcgaaagtcactcccaatttgaagcagaacttacacttggcaatctgtttcgttctcgaggcgaagttgatcgtgcattgcgcattcatcaagctttagatcttagtcctaattatacttttgaacaaaaattacttgcaaaacaacagcttgctcgagattttatggtggttggtttttttgaccgagctgagaatctttatattttactagtagatgaacctgagtttgcagaaaatgctttacagcaacttttagtgatttatcaaaagacaaaagaatggaaaaaagcagtcaatattgctgaaaaactcgctaaaataaagccgcaagagaataatattgaacttgcgcaatgttattgtgaatattcacaaagtttagagcctgaaagtgcggttgaaaaacgcagtgttttacaaaaggctttgtcggtttctccgacttgtgttcgcgcttctttattgcttgcaaatttagcaatgcttgacggtcaatatcaacaagcagtaaaaatattagaaaatgttttggagcaaaatccagattatacgggtgaaattttgttacctttaaaacattgttacgaagaattaaatcagttagataattttgagttatttttaattcgtgcaggtcaaattattaataatgatgaagtagagctggcactagctaaattaattgaagaaaaagatggcaagtctgctgctcaagctaagctttatcagcaactcacgaaaaagccaagtactttaattttccatcgttttatgcagtatcaaattgatgatgcagaagacgggcgtggaaaagaaagcttaattttattacataaaatggttggtgaacgaattaagcaaacatcgccttatcgttgtacaaattgtggttatcaaatccataagctattgtggaattgcccatcttgccgtcaatgggaaagtattaaaccggtttcaaatcaagaacataattaattgacactcagtgaggtaacattatgacaagtaaaattattgtggcattggatttcgagaaagaagcagaggctcttgctttagttgatcaaattgatccaagtttgtgtcgattaaaagtgggtaaagaaatgtttactacacttggtattaattttgtaaaacaattacatcaacgtaattttgatgtttttttggatctgaaatatcacgatattccaaatacggtagcaagagcagttcgttctgctgctgatttaggcgtatggatggtggatttacacgcaagtggtggcttgcgtatgatggaagacgcaaagaaaattcttgaaccttatgggaaagatgcgccattgcttattgctgtgacggtattaaccagtatggaagacttggatttattacaaattgggattaatgcatcgccaatggaacaagttttacgcttagctcatttaacccaacgggcaggtttggatggtgtggtttgctctccgcaagaagttgaaattttacgtaatgcttgtggagaagactttaaattagtgaccccagggattcgtccaataggaactgattttggcgatcaacgacgtgtaatgacacctaccgcagcaattcgtgctggttcagattatttagttattggacgcccaataactcaagcggataatcctgcggaggttctccgttctattaatgtatctattgggtaatcataaatgtcagattctgttttagtgtattcaacagatgtgggtcgaattaaagaggaaaaggcttctgtagttcgcccaaaaggagacggtgttgtacgtattcaaaaacaaacgagtggtagaaaaggtgctggtgtatcagttataactggtttagatttatctgatgaggaattgaaaaaattagctgctgaattaaaaaaacgttgtggatgtggtggagcagttaaaaatggtattattgaaattcaaggggaaaaacgagatttgctcaagcaattattagagcaaaaagggtttaaagttaaattatcaggtggatgattaaaaaggcgcattagtgccttttttgttagagattcaaaatttttttgacgaaaggaatcgtaagatttcgttgagcttgtaatgatgctttatctagtagatcaagtgcttcaaatagagtatgcatatctcgtgctagtcgtgtaattaaaaaatttgcagtttcgtcagataattggaatcctcgttggtaagctgcgagttgtagtactttgattttttgttcgtctgttaatgaatttaattgataaatttccccccaagttaagcgagagtttaaatcaggcaatttgacagaaagtgcggaaggcgatttatctgcactaattagtaaaagcgttttcccgcttgctttaattcgattaaacagatcaaaaatagctaattcccattcatcatttccgattacactttgtaaatcatctaagcatactaattcttgttgctctaaattttcaagaactgcggtagaaaaatattgagatttgctaaggggtacataaatagcagtacgttgattgattaaatattcgttactgaatgctctaagtaaatgggttttaccagagcctttatctccccaaatgtagaaaaacggttgttttaaatcagatgaatttttgcgtaaagaatcgagcaataaaagattattatcgccgtaaaagttctctaatgtagcatcatcaatttgatgaataggtaaggggagttgcttattcaaatgtttatgtagtacagattaagtaagaaagggctaaatgataatttaaccctttgaaatggggcttattctacttcattttttgctttcggtaaaacaaggtttaagatgatagcaacaatcgcacacaagctgataccttttagtgatacgttacccacatctacaaacatattgccgataccaaatgtcattacgacagaaataatacaaagattacgagcttcggtaacatcaacttttccgcgaattaaggtactcatgcccacaactgcgattgaaccgaaaacaagcatcataattccacccattacaatagttggaatggttgataggaatgcgcctacttttccacagaatgaaatcgcaatagcccaaactgcagcccaagtcataatatttgggttaaagttgcgtgttagcatcacagcaccagtaacttccgcataagtcgtattaggcgggccaccaactaaagaggcagcagcggtagcgatgccatcgcctaataaagtgcggtgtaatcctggtttttttaaaaagtctttacctgttacagagctgattgccataataccgccaacgtgttctacggcgggggcaatggcaattggtaacatataaagaatggcttctaggttaaattcaggtgtcgttaatttgggcaaactgaaccaaggcgcatcaatcactggttggaaattaattaaacctagaaataaacacaaaatatagcctgcggtaataccgaacattattggaataagtttcatcaatcctttggcaaatactgccacagataaagtggtaagaagcgttaccattgaaactaatactgcgtcgttataagcataggcactgtttttgcctaaggacatatccaccgcaataggtgcaagccccatgccaatgataataattactggcccaacaaccactggtgggaaaaaacgttgtaatgcttctgctccccgtaattttactaaagtgctcaaggcgaaataaacaagaccagtgaacgctaaaccgcccatcgtagtcgcaattccccaagtttgtacgccatattgaatgggcgcgataaaggcaaaagatgatgccaagaaaataggcacttgtttgcctgtgcaaaattggaagagtagggtgccaacgccagcggttaataatgccgtattggaatcaagtcctgtaattaatggcacgagtactagcgcaccaaatgcaacaaaaagcatttgtaggccaacgaaagattgttttaatttgctttgattttccgctagggaaggagggatttggtttgtcatttagtttcaactctctgtttgaattaacttaaaagtgcggtcagtttttcttgtgtttcaacgcacggaaaaaagacggcttaaatgccgtcttgttttggggattattttgtcccaaaaattttatcgcccgcgtcaccaagaccgggaataatgtaaccttgttcatttaaatggctatcaatagaagcgcagtaaagttcaatgtcagggtgtgcagcctcaagagctttaattccttctggtgcagcgactaacactaatactttgatatgtttacaaccttttgcttttaaaagatcaagggtggcaatcatagagccgcccgttgcaagcatcggatcgacaacaattgaaagtcgctcttctaaatcgctagctaatttttggaagtaaggaactggttcaagggtttcttcattacggtagatccccactacgctgatgcgtgcgcttggtacgtgttcaagtacaccatccatcattcctaaacctgcacgcaaaattggcacaaccgttacttttttacctttaattcgatcgatttctactggcccattccaaccgttgatcgttactttttcagtttctaaatcagaggttgcttcataggttaataggctaccgatttctgttgcaagttcacggaatttttttgtatcaatctcagcttcacgcatcacacctagtttgtgttttacaagtggatgttttacttcaaccagtttcatttttactctccttttgactcttaaaaaacaaattgacaaattctagattaaaaaaatacaaaatggtagaggtttataaaaatattctgacttgaaacgggagttttcaatacaatattgtctttaaactggtcgaatactctctacatctaattttgcatcaaactcattaagtagaatttgtaatttactatctttttgcaactcattttgagctttttcccgcaatgcttgataaatattgcggcgatattcaattggcgtcgtgacattgctatcatcaagattaattgttaatcgaatatctttaccttgtaatttgcttaatgcttcagctaaattttttatacttctgtcttggcgtaaatgggatttttctgaatgtagtccaagattgatttcatcatcggttttgctttgtaagaaacaatttaatgctaattctttgctaaatcctgttaagccagaacgctcaactatatctgcccactgatcttgttgttgagtttgggtaatgatttttaaacgtaattcaggcgtaatatcttttaaaatcgcctgttttatatcagaaggacaaacgcctgtatcggctttagcaagttctggattgctccattcccaacgataggtgtcagcactcaagatttcttgctcatcttgagcaatttctacattatcatcacttgaattttcttctgtgctatttttttgtggagcctgtgcggcatttgatggtaatgttggcttttctatgtgcttgggcttcggctcagtcatttctcgcacgggaagtgcggtcatttttttatgagatttttcttcgtctagttcttggatgtgatgtaaggtttcacttactacagctaatgattcagctttgtgttcttgacgttcttggttttccagttgtgttaaatgttcaagcgcatctaaagccgaaaggcttgccaaatttggaatgctcgttttatttggttttgcttgagaataagcagatttgatactttgcgacagtactggcacatcgacataattacccgtattttcaaccgcacttggcgttgatggcggtggagtaatagtggtgttagcctttggtactgccgtaaggaactttgggtggaatgccaatgccctcaataatgtcatctctgcaccaatacgacgatttggtgcatttgataaatcttttctaccagaaacaatgacttgataaaaaaactgaacattttctggagagatatgtttggctaaaaatgaaaaatgttcattgttatctgaagatttttgtggaagaagttgcataagcgcaatttgatgtaatttttctgcacattcgccaagtaatttatcccaatcgcctgccgcatcagcaactctttgtagtgttcgcattaagagttcgccattgccttgatgtaaggcgtataaaatatcaacagaatagttatcatcaagcaaccctaacatattgcttacaacattatttgtaacttgtcggtcgcccattgcaatggcttgatccgttaaacttaagctatcacgaatacttccttgcgccgcttttgcaagtttaactaatgcaggatcttcaaaaggaatattttcttgcgtcaaaatatgggcaagatgctgggagatttgagtttcatctaatgctttaagatgaaattgtaaacagcgagaaagaatagttacaggtagtttttgtggatccgttgttgcgagtaaaaattttacatattcgggcggttcttctaaagtcttgagcaacgcattaaatgaatgacgagatagcatatggacttcatcgattaagtaaaccttaaatctgcccacaactggtttatattgcacgttatccaataattcacgcgtgtcttcaacttttgtgcgagacgccgcatcaatttcaattaaatcaataaaattgccttgctcaatagctttacaattttcacattcgccacaaggcgttgccgttacaccgtgaacacaatttaatccttttgcgaataatctagcaatagaggtttttcctacaccacgcgtgcctgaaaagaggtaagcgtgatgtagtcgattatcttttaatccatttgctaatgccgtgataatatgttcttgcccaacgacatcagcaaatgtttttggtcgccattttctggctaagacttgatagctcatcgaatccttaattaatgaccttcaaaattgacgagtgtatagcaatcaacgcccaaattatttaagcgtttttcgccacctaattcaggtaaattaatcacaaatgcagcgtgttttaccgctccacctaaacgttgcactaattttactgtcgcttcaactgtgccaccagttgctaataaatcatcaataattaaaacattgtcaccttctgaaattgcatcaacgtgcatttccaaagtatcttgaccatattctaattgataagattgcgaaatagtctcacgtggtaattttttaggtttacgtactaattcgaaaggtaaacctagtgctaaggcaacgggggcaccaaaaataaaaccacgagattcagttccaagcactttggtaattcctttatcgcgatattgttccacaataagatctattgttgctttaaaagctgctggaacttctaaaagggtagtaatgtcgcggaagataatgccttcttttggatagttaggaattgatttgatagaagatttaattaaatcaagttgtgtagtcataaataatgctcaaaagtgcggtaaaaaaagaaacgtttttagattggcattctatcataaaaaaatagaaagagaggaaaataaaaatccccaattggggatttttatttaagtttgaatttacaatttaagatgaattaaaacttcttaaatagaaattattttttccttcgcttttgcatttggaaggtcagtaattgagccttcaaatacttccgcagctaagccaacagactcgtgtaaagttgggtgagcgtggatagttaatgcaatatcttctgcatcgcaacccatttcaatggcaagaccgatttcgcctaataattcaccaccgttagaacccactattgcaccgccaagtacacgatgtgtatctttatcaaagattaacttcgtcataccttctgaacattcagatgcaatcgcgcggcctgatgcagcccaagggaatttagccacttcgtagtttaagccttcttgtttacattctttctcagttttacctacccacgccacttctggttcggtataagcgattgatggaattactttaggatcgaagtagtgtttttgtcctgcaatgacttctgcggcaacgtgaccttcgtgaacacctttatgtgctaacattggctgacctacaatatccccaattgcgtagatatgtggcacgttggtacgcatttgtttatcaacgtgaataaaaccacgatcatccacttcaacacctgctttacctgcatcaattaatttaccatttggcacacgaccgatagcaacaagcactgcatcataacgtttggtatcattacatgctttgccttccattgaaacgtagataccatcatcttttgcttcaactgcagtcactttggtttcaagcattaacttgaattttttctcaacttgtttagtgtaaataccaacaacatctttatctgctgcaggaatcacttggtcgaacatttcaacaacttcaacttcagaacctaaagcattgtatacagtacccatttctaaaccgatgataccaccgcccataataagtagttttttcggtacttcttttaatttgagcgcatctgttgaatcccaaatacgaggatcttcgtgtgggataaagggtaattgaactggacgagaacctgccgcaataatggcattgtcgaatttaacagtcgtagggtttccatcgcgatcacgcgcaactaatgtgtgagaatcggtaaaagtcgctaaaccttcaacaacagtcactttacgtgcttttgccattcccgctaaaccgccagttaatttagcaacaacagcttctttacctgcacgtacttcatctagctcaatgcgtggttcactaaaataaataccatttttattagcatgctttgcttcttcaattacttttgcaacgtgtaataacgctttagatggaatacaacctacgtttaaacacaccccacctaaggttgaataacgctcaacaataacagtttctaatcctaaatccgcacaacggaatgcggctgaataacctgcaggacctgcaccaagtacaacgacttgggttttaatttctttactcatttttacctcgtaaaaacgttaaaaatattgaccgcacttttacggtctttataggatgggtttctgcccaccaaagatttcattaatcggtgggcttaaagcccacctacagattacattactaagcgacgtaaatctgctaaaacagagccaagatagctaatgaaacgagctccatctgcaccatcaatgacacggtggtcgaatgataatgacattggaagaattaagcgtggcgcaaattctttaccattccatactggttccattgatgatttagacacaccaaggatagctacttctggcgcatttacgattggtgcaaagtgcgttgtaccaataccaccaagacttgaaatggtgaaacagccaccttgcatatcagatgcagtcaatttgccttcacgggcttttttcgatacttccattaattcacgtgaaagttcgataatgcctttcttgttcacatttttgaatacaggcacgactaagccattcggcgtatctactgcgacaccgatgttaatatattttttcaggattaagcgttgagcatcttcggtaattgagctgttgaaacgtggatacgcttctaatgcttttgccaccgctttcataataaacacaactggcgtgatttttacaccgagtttttgtttttctcgtaacgcattttgttctttacggaatgcttctaaatccgtgatatctgctttatcgaagtgagtgacgtgtggaattattacccagttacgatgtaagttagcacctgaaattttgttgatacgacttaattcaacttcttcaatttcgccaaatttactgaaatcaacttttggccatggcaataagcctaagccagcaccatttgctacaccattgccagtagcttgtgctgttgcaccgctttcataggctttaactgcggtcttcacataagcttcaatatcttctttaacgatacgacctttacgaccagtaccttttactttatctagatttacaccaaattcacgagctaaacgacgaattactggtgttgcgtgtgcatatcctgtacttgcttctacttgttcttggcttaatccagatacgttgttatttgattgagctgcttgtgcagtagtatcaggagctgctgcctgtggtgcttgtgcagtagtatcaggagctgctgcctgtggtgcttgtgcagtagtagcaggagctgctgtctgtggtgctgatgttgaagctggagctgatgctgattctgctggagctgcacctagtacttcaaaacgcataattaatgaaccagttgaaactttatcgcctgatttcactaaaatttcttttaccacaccgccgaatggtgcaggaacttccattgaggctttatcgccttcaacggtaattaaagattgttcttcagtgattgtatcgccaactgcaaccataatttcggttacattgacttcatcgccaccaatatctggcacatttacttctacaatagctgaagccgttggtgcggtagcaaccactggtgcagtaggcgcatcagctactggagcagtaggctcatcagctgctggagcagcacctgccgcttctaatacaagcattggagtaccagttgaaactttatcgcccactttgactaaaatttcttttacaacacccgcttctggtgcaggcacttccattgaagctttatcgccttcaacgttaatgatagattgatcaacagaaatggtatcgcctacgtttaccatgacttctgttacggtaacttcatcactaccaatatcaggaatttgaatttgttttgacattttttgttccttttaaagtgcggtcataaaacacaatgttttttgaccgcagttttcatcaattacgcataaagcggattgatacgatctacattcaaaccgaatttcgcaatcgcatctgcaaccacttggttagatactgtaccttctttcgctaattgagaaagtgcagcaaccacaacataacgtgcatcaacttcgaagtgttcacgtaagtttgcacggctatctgaacgaccgaaaccgtctgtacctaatacatgatagtgcttacttggtacaaatgcacggatttgatcagcataacctttcacatagtcagttgaagcaacggttggtaaatcagctaatacttgagcaacgtatggtacgcgttgtgtctctgttgggtgtaataagttccaacgtgctgcatcatgaccttcgcgtgctaattcattgaatgaaggcgcagaaaatacatctgaagtcacaccgtagtcatttgcaagaatttgtgccgcttcacgaacgtgacgcataatcgcaccagaacctaataactgaacgtgacctttgccttttttaccttccactgtttcaaatttatataaacctttacggataccttcttccgcaccagcaggcatcgcaggttgatccatcacttcatttaatgtagtcatataatagaacacatcttcttgtttttcgccgtacatacggttgataccgtcttgcataataacagcaacttcaaatgcaaatgatggatcgtaagtgatacagttaggaatgatacccgcttgaatatggctgtgaccgtcttcgtgttgtaaaccttctccatttaaggttgtacgaccagaagtaccccctaccataaagccacgagctaattggtcgcctgcagcccacatcatatcgcccacacgttggaaaccaaacattgagtaatagatgaagaatggaatcatcggttggttattgacagagtacgagttcgctgctgctaaccaagatgcggttgcacctaattcattgataccttcttgtagcacttgaccatcttttgcttcacgatagtaagccactaaatcacggtctgaaggtatatagttttgaccatgtgggttataaataccaacttgacggaataaaccttccataccgaaagtacgtgcttcatccgcaatcattggaacgatagttttaccgatgtttttatcttttaataagatgtttaatgcacgagtaaacgccatagtggttgaaataccacgaggttgttcttctaataatgctttaaactcttctaatgcaggaactttatattcaacatcaaatttagtacgacgagcaggaacataaccgtttaatgctttacggtgaccatgtaagtattcatactcaggtgtgccttcagcaaatttaatgtattctaatttttctacttgttcatcggttaatggtaattcaaagaagtcacggaaacctttaaggctttcgtaagacatttttttagattggtgagcggtatttttactttccgcttcaggaattttataacctttaacttgatgcgctaaaatcacaactggtttcgttgcattttgtgcttttgcataggccgcatataatttttcgctatcgtgtgcaccacggcgtaatgcccagatttcatcatcggtcatatcagcaactaatgcagcagtttctggataacgaccgaagaagtgttcacgaatatatgcaccatctttagatttaaaggttaaataatctccatcaaccacttccatcattaactgagttaatttacctgaagtatctttcgcgaataatttatcccaatcgctgccccataaaactttaatcacttcccagccagcaccagtaaatagcccttctaactcttgaacgattttaccattaccattcacaggtccatctaaacgttgtaagttacagctgatagtgaagattaagttatctaagtgttcacgagccgcaaaagttaatgcacctttagactcaatttcatccatctcgccatcgcctaagaacgcataaactttttgatctttggtatcttttaaaccacggttatcgagatattttaagaaacgcgcttggtagatggcattcacagggcctaaacccatagaaaccgtagaaaattgccaaaattcaggcattaatttaggatgtggatatgaagataaaccgtcggtaaaggcttcttgacggaagttatccatttgttcttcagttaaacgaccttctaagaaagcacgcgcatacataccaggagctgcatggccttggaagaaaattaaatcgccaccgtttttctctgttgcagctttaaaaaagtggttgtagcaaacttcatacattgttgctgcagattggaaagtggaaatatgcccacctaaatcaagatctttcttctgactgcgtaaaaccatcgcgatcgcattccaacgtactgctgaacgaatacgacgttcgatagcgtgatcacctggataagcaggttgctcagccacaggaatagtattcacgtaatcagtggtaactcctgttggcaatgaaacaccacttgtacgtgcttgaccaataacttgctcaacaatatattgagcacgctcaacgccctcttcacgaattaatgaatctaatgattgcaaccaatcttgtgtttcgattggatcaacgtcattttttaaaatctcagacataggttttccttaatctgttttgagtgaatattagtttagacaaggctaaacacgaatacggcaatatttgcttttcacaaacatttaacaaatcttgtaaattttagaagattttttgagataaagatagtgaattttcatcaaatcatcatatcaaatcagctttgccataaataattatttgaaagtgcggtaatttttttgtgtttttttgttcgctaaaataaccagtaaaatattgcattccatcgggctttgttttaaagttttttcagatttttttcaaaaaggactcagcaatgcagacaacaactcgaaccctcactcaacacaaacgtattgcacttgtggctcacgatagttgtaaaaaaaatttactgaattggacgcaaaaacacaaagaggcacttaagcctcatatactttatgcaacaggtacaacagggcatattttagaacgagaaacaggtttaagcattcaatctttattaagtggcccgatgggcggcgatcaacaacttggtggattaatcgcagaaaagaaaatcgacatgatgatcttcttttggganccaatgaatgctgcaccacatgaacctgatgtgaaagcccttatgcgtattgcaacagtgtggaatattcctgttgcgattaatcaaagctctgcagattttcttttaacttcagttttatttgaacaagatgtggaaattgacgtaccagattatgaagggtatttaaaagagcggttagcttaaactgcaacgaaaatttaccgcactttatagttgtaggtgggctttagcccaccaattaaccataaaaaatggaataaaaacggtgggctgaagcccaccctacgatacttttaattaaatacaaaacagggcgacaatttatcgcactgtttcagttatctcccaaatccccccattacaagtataaagagtaccactttcaactgtncttctgggattggcttgccgtttagtttcaagtcgttattttctagagcaagcgttaatgttacggttttgtccgtgtttacgataatgccattngcttcgccttcagcaattaattcgtccattctgtaaactaaatcttgcttttggttttctggtacaaatttagataacaatgaaatcgcagtttctttgttcacatcaaaattgatcgaaaaatctttgaattgtttgtataagccactgtgcattaaatcaaatttaggatttggcactaaagcaatatttagatccaatgccactttgcctttttcatcagaaatagaaagaggggtaaacttaatttgaggctgattattcgcaatggccatgcctgcttgttgtaatttttgcaccaatgttttagatagaggcattctgagtcggctttgcctatagcaactaaaatatttaaaagttcttgtaatgcgttgccatcaatatggttgaattctacattgttggtcactttacctaagttgttaccgttaatatgtaattcatccagatttgttttattgatgatatttactgtatcaccctcaacttgtgtagttaaatttgcttggctgtttttctgaataagagagaatttttcgccactctctgcagattcggtattttgctcaaaatagcctattttactattgatattcccactataaataaatggccattttgtgctttgcaacgagccttgtacgacaagatcttttattttaattgatgaagcggttgaaactgcatgattaggggcatttgaattaaatgtatcgacagatagcacatagttatttggtgtattttggtttaaatcaatatttaatacgacatttgaccaatcaaaatctgtcttagattgctcattgtgatattgccccgatgcaagttttaattccgcattaccgcttaatgaataattcattgcgaaattcagttgtaacggtttctctgattctgtgatatcaaagaatgcctgagttgttgcattttttcctaacaatgtttggcttgaaaaaatggctggaacgaaattcagttttgccacacgatcaagcggcaaaggcccgtgataaagtgttgatgataaaggaataatgatcgtttcatttgccttgtgaatttctatttgatcttgaatgtgagaggcaaataatcctctttcaaattttatatttttataaaaaattttactttcttctaatgcctcagttttggtaaatagttgatttaactgttctagttgatataaatattcttcttcagcttttttccctgtaaaccatgcacttgtgcaccaaacggcagcaagagcaaccactacgcctgcagcaatttttgattttttcatttatttctttcctattttaaagtaaaaattttcgccaaatttatcacaaatccctttttcttgcctgaaaattttgttttccccttgaagttcatcatttgagacttattttgaaaaacaagaacggaaattaccgcactttaagaaataaaaaatttttaaaattttctcttgaaatgcgaaagaatatccacatcttacaattcgtaataaataggtctaaaagccctaccccgaattttaaaatttttactaggagtacaaaatgggaaaaattattggtattgacttaggtacaacaaactcttgtgtagctgtaatggacggcgataaagcgcgcgttattgaaaatgcagaaggggcacgtactactccgtcaatcattgcatatacagataatgaaaccttagttggtcagccagcaaaacgtcaagcaatcactaacccaaaaaatacattgtttgcgattaaacgtttaattggtcgtcgttttgaaagtgaagaagttcaacgcgatattaaaattatgcctttcgaaattactcgtgccgacaatggcgatgcttgggtaaacgtgaaaggtgataaattagccccaccgcaaatttcagcagaagtgttgaaaaaaatgaaaaaaactgcagaagatttcttgggtgaatctgtaactgaagcagtaattactgtgcctgcatacttcaacgacgcacaacgtcaagcaacgattgatgcaggtaaaatcgcaggtttagatgttaaacgtatcattaatgaaccaacagcggctgcgttagcgtttggtttaggttcaagcaaagagaaccaagtgatcgctgtttacgacttaggtggtggtacatttgatatttcaatcatcgaaattgataactttgatggcgaacaaactttcgaagtattggcaaccggtggtaacactcacttaggtggtgaagactttgataaccgtgtaattgattacattattgatgagttcaaaaaagaacaaaatatcgatttacgtaatgatgcaatggcattacaacgtgtgaaagaagctgcagagaaagcaaaaattgaactgtcatcagcgcaatctaccgaagtaaacttaccttacatcacggcagatgcgacaggccctaaacacttagcattaaatatcactcgtgcaaaattagaagcattagtagaagatttagtggcaagctcaattgagtctttgaaagcggtattaaaagatgcagataaaggtgtaagcgaaatccacgatattattcttgtgggtggccaaactcgtatgccacttgtacaacaaaaagttgctgagttctttggtaaagaagcacgtaaagatgtgaaccctgatgaagcggtggcaatcggcgcggcagttcaaggtggtgtattaaaaggcgatgtgaaagatgttcttttattagacgtaactccattatctttaggtatcgaaaccatgggcggtgtgatgaccactttaattgagaaaaataccacgattccaactaaaaaatcgcaagtattctcaacagcagaagataaccaaagtgcggtaactattcacgttcttcaaggcgaacgtaaacgtgcggcagacaataaatctttaggtcaattcaacctagaaggtattaatcctgcgccgcgtggtatgccacaaattgaagtaacatttgatatcgatgcaaacggcgtaatcaacgtatcagcaaaagataaaaatacgggtaaagagcaacaaattcgtattcaagcatcatctggtttatctgatgaagaaattcaacaaatggtgcgtgatgcagaagcaaatgctgatgcagaccgtaaatttgaagaagttgttcaagctcgtaaccaagcagatggtattgctcacgcaacacgtaaacaaattgcagaagctggcgatgcattgagtgtcgcagacaaagagaaaattgaagctgcagtcgctgagcttgaaacagcagcaaaaggcgaagataaagcagaaattgaagcgaaaattgaagcagtaattaaagcctctgaaccattaatgcaagcagtgcaagcaaaagctcaacaagctggtggcgagcaaccacmacaatcatcagcaaaagatgatggcgtggtagatgctgaatttgaagaagtgaaagataataaataattcaccgctcttcttagcataaacaaagggcgtggaaacacgcccttttggtgtatttattttcagcaacaaattacaaaattactatggcaaaaaaagattactacgaagtccttggcctacaaaaaggggcgagtgaggacgaaatcaaacgtgcgtataaacgtttagcgtctaaacatcaccccgataaaaaccaaggcagtaaagaagcagaagaaaaattcaaagaaattaatgaagcttatgaagtattaggcgacgatcaaaaacgcgcagcctacgatcaatatggccacgcagcctttgaacaaggtggtggcgcaggtggcttcggtggcggctttggtggtgctgattttggtgatatgttcggtgatatttttggcgatattttcggcggtggtggacgtggtcgtcagcgcgttgttcgtggcgaagacttacgttatgacttagaaattagcctagaagaagccgtaaaaggtacaaccaaagatattcaaatcaatactcttgcacattgtgatagctgtggtggctctggggctgaaaaaggttctaaagtggaaacttgtccgcattgccacggttctggtcgaattcgtcgtcagcaaggtttctttgtatctgaaagtatctgtccaacttgtcatggtagcggtaagaaaattgaaaaaccttgtcgcaactgtcatggagaaggacgagttcataagaaagaaaatctttcagtaaaaattcctgcaggcgtagatacgggcaaccagcttcgcttagctggaaaaggtgcagcaggtgaaaatggcgcaccagcgggagatttatatgttgtgattcacgtgagagaacataatatttttgaacgtgatggctctaatctttactgtgaagtaccgattagctttgctactgcagcgcttggcggtgaaattgaagtgccaactttagatggtagagtgaaacttaaaatccctgctgaaacgcaaacaggaaaattattccgcatgcgaggcaaaggtgtcgcttctacacgtagtggttatgcgggtgatttaatttgccgtatcgtggtagaaacgccagttaatttaaccagcgaacaaaaagaattactccacaaacttgaggaaagtttacaaggtaaagatttaagtaaacatgcaccaaaatcttcaggatttttagacggtgtgaaaaaattctttgataatttgggtaaatctgacaaataaagataatgaaaaagtccgcatttcgcggacttttttatatgcaaataatctcttctaaaaattaccgcactttaggttttatttgcggacagtatattcgccttcacaaacccatttataactggttaatgcttctaatcccattgggccacgagcgtgaagtttttgggtactcacggcaacttctgcgcctaatccaaattgtccgccatcagtaaagcgtgtgcttgcatttacataaacggctgccgcatcaacttgattgataaattgacgggctaggctttgtgaggaagttaaaatactttcagaatgttgcgtaccatattggcggatatgctcaatagcggcatgaatatcttccacaacaaccacattcaaatccaatgatccccattcttttcgcaattctttttctgtcacttcgcagacattcgcacccgcttgtttcaatatattaagtgcggtggattttgcatgatattttacgtttttagcggaaaggtgagagacaagtttaggtaaaaattcttcagcaatagaatgttgaactaacaatgtttccaatgtgttacaggtgcttggacgttgggttttggcgttatcaataacaaaaatcgctttattttgatccgcacttttttcaacgaaagtatgacaaacacccacaccacccacaataacaggaatagtcgaatgttgtttacacaattcatgtaaacccgaaccaccacgaggaataatcatatccacatagcgatccagttttaataattgcataacgagttcacggtttggatcggtaatggcttgcaccgcaaattttggtaagcctgcttgctctaaagcattttgcacaacttcgattaaaatcttgttagaaaactgtgtttctttaccaccgcgtaaaatcactgcattacccgttttaaggcaaagacttgccacatcaatggttacatttgggcgagcttcataaattgtaccaatgacgcctagcggagtgcgtacgcgttcgattttaagtccgctatccaatgtaccgccgtctatgattttccccacgggatctgctagagaaataacgtggcgtacatcattagcaatgccttgtaaacgttcttgtgtgagcagtaagcgatcaatcaaggcatccgataatccattttgtttggcaagttcaatatcttttgcgttttcggctaagataagcggtgcttgttgttcgagttgttctgcaataatggataatgcacaatttttttcagcagtggtgagttgagccaagataaatgctgcatctttggcttgtttacccatttgttctaacatagttattccctttattgtatttatttctttttatttggctgcttatcttgttcttccgatgtgagttcttggtaattaaacaccggcaacccccattcgaaatgaatagctaaaaggcgtaaagtaaagctgttaataagtgtgagtaacacggcaagtgtatgttctacttgaagtgtacttaatgcgtaataagtcagcgtggcaaatagcgcaatgctggcatagagttctttttggaatacgagaggaattcgattgcatagcatatcgcgtagaaccccgccaaaggcaccagtaatacagcctgcaatacaaacaatggtaaggctatgtcccatatccattgcaatttgtgcgccaataatggaatacaccactaagcccatcgcatcaagcaccaagaaaatagtgcgaaagtagcgcataaaatgattgataaatggtgcaacatatacggtaattaccgccgcacttgccaccattaaaaaatattctgggtgcttaacccagccgagagggtaatgcccaagcagtacatcacgcacagaaccgccaccaatggcagtgacagatgcgataatgatcacgccaaaaatatccattttttcacgacctgccgcaagtgcgcctgtcattccttcagcggtgataccgatgatatataaaatactaagtaacattcatgtacctaagtgcggttaaaattggtttcattttactttaaaatttaatgaatttttagcataatggcgcattattttttcagacgtcaaaattatgtcagaacaatcttctaaatatatcgcagcattgcttgcggtattatcgatctcaatggtgcttggcatcgatctatttattttttctttgcaatctgaaaagcaaacaatgcctcatttaggtgtaggcgtgttggttgcacagttaatttcgttgttggtgttttatcgtggcgaaatttgcccaggacaacgtggtcgtttaatcaaagtgaatatgacttttgctatttattgggcagtgtggttgctgataagcctattacaaaataatcacacgcttactaacgtgatgagcgtatgtggtctttctgtcgtgtattttatttggaaacaacccaaaactgaaaaaattcgtaacagctttttattgatggctgcattaattgcgggtttaggttgcttgagttatttaatgatttttaccgagcttcctgcgagtgattttgctgaatataacccttttgcaccaattttatctggcgtgattttggcaaatcttgtgcttgttattgcangaaatcgtttacaaggttttatagcattgttgcccttagcaatgattatattgcttgctctaaatgctttggcaatgtttttatttttacttttaaatggtatggaaagtgcggttaattctgagagtgtttttgcctacatcatttattttgtttgccattttgtgattgcggctattctgattctgcatagtttccaaaagtggacattatctaccaatagtttatttatcctattatttattgctgtttgcttgccgttatggatggtttttgtttaataaagaaaacaatcattgcgccgtggggaatttatccacggcttttaagatttcggctggttagaaagtaatacgccaacacggaaatcacgacacatgcccccatagtaaagagcattggtgcggcagtatccattttcattgacgcgactaaacttcccataattgcacccactgcaaaacgtacgctaccaatcaaagaatttgctgttcctgccatttgaggacatctttctaaagctgatgccattgcatttgatgaaatcactgggtttggaccgacgaaaaaggcgacgccaattgccattggccaaaaaccgagatctaaaagtgcggtcaaaattagccacattccagaaaggaattgaattgcgagggctatccgtaacattgtttctgcacccactttagtaacaaatcggctatttaaaaaagaggcaaagatcatcgtaacgatattcatcataaagaaataaccaaactgatcgacgggaacgccataaatgccgatatagacaattgatcctgcagtcacaaaagcaaacaatccaccaaagctaaaagaggcggcaaacatatagccaagcacttctttttgcttccaaagcagaaggaaattgcgagcgataatatttaagcgcagcggaatgcgattttcttttttatgggtttctggaatgatgaaaaagaccaatgcagcggctaataatcccacgagcgaaataacgtaaaaaatcgcatgccaatggaaaaatttaacgatgtaaccaccaatgattggtgcaactaaaggtgcaagcataaatactaacgtgatggtggacatcactttggatagctgatctttactaaataaatcacgcaataatgcgccagaaagtacaacaggtgcggcaccaaagaaaccttgcacaaaacgaagtgcggtaaaatttccaactgaatttatttcggtaagcactaaagctgttaatgcgcccacaataacaccgagtaaaatgatcggttttcgtccgaaactatcaccaaaaggcccccaaaaaagctgaccaaacgccatgccataagcaaaagaggtgagcgtgtgttgtacttgttctggacttacgtcgagatcctttgcaatttctaaaaaagacggcaaatacatatccacgccaaagggcggtagcatagagagaataccgagggtaagaataaagatgaaagtcgatttttgttgattcatattattttactaacttttcaatttcactttgagttaatgggcggtattcgccttcttctaaggattcatccaacactacatcaccaattttccagcgatgtaatccaacgactttattcccaagtgcggcaaacatacgttttacttgatgataacgaccttcagaaatggtcagattcacattgtagtcatctaaaatttctaattttgctggtttagtgggctctttttctccgcgtaataaaatgccttctgcacaagctgctgaataattttcttctacgggatcagctaatgtcaccaaataggttttttcacaatgatgctttggggaagtgatgcgatgtgaccattgtccatcatcggtaagcaatacgagacctgtcgtatccacatctaagcgacctgcgctatgtaattttccagctaaagggtaatcaaaaaattgataaattgttggatagtcgccgtcatcattagaacaaacacagccttgtggtttattcaacataaaatactggccttcttcgatccaagttaataattcatcttcaaaataaatttcgtcttcttgtgaaatttgaaccgaaccacttttgacaatttcaccgttgatttttaccgcactttggcggatcgcttttgttgcttgagaacgagttaatcccacattttcagcaataaatttatctaatctcattatgttttctcttattaaaattcgctaggcattttacaggtttttgcttttagaacgaaacaaaaaaggctgcaatgcagcctttatctattaagcgtggttaaaccacttcacgtaatcgaattgatcgtaatattttttcccattccagccagaaaattcaaaaatatcgcccacttgattttgcttctcgaagccttttatataataagccgatttaaaagctggatagggcttgtgagtaaaaatcactttatttttgaaagggagttgatcaaaaagttgaatgtctttttcggtcacgccgtctcgatctgtcatcataataaaaagattgtctaacttcattcgtgacgtgcgaagttgccatttttcattggcttcttgctcactgtgataatgcataaaatgaatttcaagatcggcaagttttcccactggataacttttttctgtttgtacgaatgtgagaggttgagtgaggtaaaaatctatattttgtaaataacgcaaaaaatcctgtggcgagagatagagattcacaaaaggggaattaaacggctggtgtaaatcatgtaagataaaagcccccacgcaattggcagaaatgacagtcataccttgatttgttagtttacgttgcagagtgcgattaatgaaaaatctttggcgtttattcaccgcacttttaattttttgaaatggattcattttctcatcctttatgcttttgttgcgaaaatcctaccttttttgctgaaaaatgaaaagtctagctaatgcctcgcatcaaaaaaattttgttataaagttgtaaaagtttgcagttcgtcacaattttttgaataaaaaacagatataatcgacgcaatatttcaatcctgtttcaagaaaatggagcacttattatgaccgaacaattacgtcaagcagccttagatttccacgaatttccaattcctggaaaaatcgaagttaccccaacaaaatcattagcaacccaacgtgatcttgccttagcttattcaccgggtgtggcagagccttgtttagaaattgaaaaagatcctgcagcctcttacaaatatacagcacgtggcaatttagtggcggtgatttccaatggtacagcggtgcttgggcttggcaatattggcgcgcttgccggcaaacctgtaatggaaggaaagggcgtgttgttcaaaaaattcgcaggcatcaacgtgtttgatattgaagtgaatgaacatgatcccgataaacttgtagatattattgcctcgttagagccaactttcggtggggtaaatcttgaagatattaaagcaccggaatgtttctatattgaacaaaaattgcgtgagagaatgaatattcctgtattccatgatgaccaacatggcacggcgatcatcagcgctgccgcgatcatcaattctcttcgtattgtaggtaaaaaaattgaagatgtacgcttagtggcttctggtgcgggtgctgcatctattgcgtgtttgaacttattgctttctttaggtatgaaacgtgaaaacatcacggtttgtgactcgaaaggcgtggtatataaaggccgtgatgacaaaatggatcaaaccaaaaaagagtatgcaattgaagataatggctggcgtaaacttgctgatgcgattccaaatgcagatattttcttaggttgttctgcggctggtgcgcttacacaagatatggttaaaagtatggctgcgcatccaattattcttgctttggctaatccaaatcctgaaattaccccgccagaagcaaaagcagttcgtcctgatgcgattgtatgtacaggccgctctgattatccaaaccaagtaaataacgtgctttgtttcccatttattttccgtggtgcattagatgtgggcgcaaccactattaatgaagaaatgaaacgtgcggcagtttatgctatcgcagaccttgcattagaagagcaaaacgaagtggtaacctctgcttacggtggcgaaggggcaacatttggtgcggattatgtgattcctcgtccatttgatcctcgcttgattgtgcgtattgcaccagcggtagcaaaagctgcaatggaatctggtgtggcaactcgtccaattcaaaattgggatgcttatgttgaaaaactcactcagtttgtttacaaaacgagcttgtttatgcgtcctattttcagccaagcaaaatcggcaaaacaacgcattattttagcggaaggggaagaaaataaagcattacatgccacccaagaagtgatttcaatgggcttggcaaatccaattttaattggtcgccgcagcgtgattgaagaaaaaattaaaaaacttggtttacgtttaactgcaggtgtagattttgaaattgtggataacgaagataatcctcgctatgaagaatgttggaaacactattacgaacttactaaacgtaaaggcattacacctgcaatcgcaaaacgtgtcgtgcgttctaacaccaccgtattagcttctacattgcttagcttaggttatgcagacgctttagtatgtggcttatttggttcatacggaaaacaccttgcctctattcgagatattattggcttaaaagacggtgtgaaaactgccgctgctttaaatagtcttgtattaccgacgggtaacgtattcttaacagatactcacgtaaacagtaatcctacagcagaagaattagctgaaattaccttaatggcagcagaagaaattcatcgttttggtattgaacctgcagttgcattgctttctcattctaattttggttcatctgattcattaggcgcaccaaaaatgcgcgaagtattacagatcgtcaaagagcgcaatccacatttaatgattgatggggaaatgcgtggcgatttagcgatgaatgaagcacacagaaaagaattaatgcctgatagcccattgaaaggaagcgcaaatttattagtgttccctgatttgagtgcatcacgtattagttatagcttattacgcggcactactacggcaattaccgttggcccgatcttaatgggaatgaataaatctgcgcatattcttaatccaggtgcatctgttcgtcgtattatcaatatgattgcctatgcagcagtgaaagcacaacaagagtaattaaaaaagtgcggtgaatttctgtcgtttatttaatgaagcctcgatttttctcgaggctttattttctagtgaatgtgtttacatttgagattaagtaaaactatgcgaaaatttaccgcactttaagacttttgtcgtgtcgaaaaggaaccgaccgatagacagttgcctatctttctttaatttaatacggcttggatgccgttgtgttagtggtttttacaatgaaaaaagcacattcccctttattccccatcttcacattcgtgttgattaatctcattatcctttccttatcccgtttgggacttgctgtgtggcaatcagagcgtgtatccgccgtagatggctggttgcaattatttttgcaaggcgtacgaatggatgttgtggcactttgttatttatttggcgtaccagcattgctcacaacattgttccatagcagtaaagtttgggtaaaaattttacgcctatggctaacctttggtagcgtgttcattatctttatggaaattgccacacctgcctttattgaaacctatgattaccgaccaaatcgtttatttatcgaatacctgatttatccgaaagaagttttttcaatgcttgcggaaggacatttaagtgcggtgatttttagccttgttttcacgattttagctgccgtgatttattggaaaatttctggttgggcagtcaaaaatttacgttcaatgagttggaaacttcgccctgtgattgctttgcttgtgattgtcgtgagcttccttggggcacgttcaagttttcaacaccgtggtataaatcctgctatggtggcattttcttctgatgcgttagttaattctctggtgcttaattcgggctattccgtcatttatgcggcacagcaatttaaagatgaagaaaaatcttcagaaatgtacggaaaaatggatgcagatgaaatgtttcgtattgttaaagccagccgtggccgtccagaaagtgattacatttcagataaatacccaactttaacgaaaaatgtcgcgacttatcagggtaaacctaaaaatatcgtgattttgttacaagaaagtctcggtgctcaatttattggaacactcggtggcaaaccactttctccaaatgtggatcagctcgcaaaagaagggtggttatttgaaaatctttatgcaacaggcacacgttcagtacgtggtattgaagcaaccaccgcaggttttacgccaacaccagctcgtgcagtggtgaaacttaataatgcccaaagtggtttctttactattgcggatttattacataaacaaggctataacacttcgtttatttatggtggcgaaaagcacttcgacaatatggcgagctttttctacggtaatggctttaaagatatttgggatcaacaagactatcagaatccaaaatttactggcacttggggcgtgagtgatgaggatttatttgataaagccaatgaaactttcacgaaattacaaaatgaaggtaaaccgttttttagtttagtatttagctcaagcaatcacgawccatttgaatatccagatggcaagattgagctttatgagcaaccaaaagccactcgtaataatgcggcaaaatatgcggattatgcgttaggtcatttctttaaaatggcaaaacagtctaattattggaaagatacgattttcttaattattgcggatcacgattctcgtgtaggcggagcaagtcttgtgccgattaagcatttccatattccagccttgattcttggtgatggcattacgccacgtcgtgacagccgtcttgtgagccaaattgatatgccaactacattgctttctttagctggcgtaagtggcaattatccaatgattggttttgatttaacgcaagatgtaaacccagatcgtgcttttatgcaatacgatcaaactcaagcaatgatgaaaggcaataatgatgtggtaattcaaatgccaaataaagcagcgcaaggttatcattatgataaatcaacagaaactttaacgccaaaagacgtacctgatgcaatgaaaaaagaggcattggctcacgctttattaggtagttatttatataaaaatcgcttgtattcttcaggtgaaaataaatagacagaacgccagcttaagctggcgtttcttttagttatcaaaaacaaactgttcacgtaattgatgtaattgatcgcgaatagccgcagctttttcaaattccaaatcttgcgcaaatttatacatttgttgttccaattttttgatttgttgttgatattctttggcatttttcggtgcattataaagtgcggttggttctgccgccatttttccacgttgtttattggctttcgctttttggtttgcaccttgcccaatatctaataattcaccgactttcttatttaatgcctgtggcacaatgccatgttcttcattgtattttgtttgtttttcacgacgacgattggtttcggtgatggctttttccatggattttgtgatgctatccgcatataaaatcgctttaccatttaagtttcgtgcagcacggccgatggtttgaattaaagaacgttcggagcgtaaaaatccttctttgtcagcatctaaaatcgccacaagagacacttctggaatatctaaaccttcacgcaataagttaattcccactaatacatcaaattcgcctaaacgcaaatcacggataatttcgacgcgttccacggtatcaatatcagaatgtagataacgcacacgaatcccgtgttcatctaaataatccgttaaatcttccgccatttttttagtgagtgtagtgactaaaactcgctcatttttatccgctctttggcgagcttcggaaagtaaatcatccacttgaattgacactggacgaatttcaataagcggatcaagcaaacctgtcgggcgaaccacttgatcgatgatttcactacctgatttctctaattcataggcccctggtgttgcggaaacatagatggtttgcggagctaagcgttcaaattcctcaaagcgtaacggacgattatccaatgcggacggcaaacggaaaccatattcgactaaggtttctttacgtgaacggtcgccacgatacatcccgccaatttgaggcacagttacatgagattcatcaataattaaaatggcatcagggggcatataatcaaataatgttggtggtggttcgccctcatttcttcccgataaatagcgagagtagttttcaattcccgagcaatagcccaattcattcatcatttcaatatcaaattgggttcgttggctgatacgctgttcttctaaaagtttatgttctttaatgaagtattcacggcgtgataccagttcttttttgatgttttctatcgcatctaaaatacgttctcttggcgtcacatagtgagttttaggatagatcgtaaaacgtggtacagcaccaaaactactaccagtgagcggatcaaataaacttaaacgctcgatttcatcatcaaataattcaatacgcaccgcacgatcatcagattccgcagggaaaatatcaataatttctccgcgaacacggaaagttccacgctgaaatgcttgatcatttcgggtatattgtaattccgctaatttcgctaaaatttggcgttgatcgataatggcaccttgttgtaaatgcaacatcatttgtaaatagctatcaggatcgcccaaaccataaattgcagaaacagaagccaccacgatggtatctcgacgttctagaaaagatttcgtcgcagaaagtcgcatttgttcaatttgatcattaatagacgcatctttttcaataaatgtatcactgcttggcacataggcttctggctgataataatcatagtaagacacaaaatattccaccgcattttctggaaaaaaagctttcatttctgcataaagctgggcagcaagggttttattcggtgcaagtaacatcgcagggcgatttaattgagcgattacattggcgatagtaaaggttttccccgagccagttacaccgagcaaagtttggtgagccaaaccatccgttaaattttcagccaatttttcgatagcttgtggctgatcgccagagggacgaaagtcggaatgcagaatgaatggttttgtgttgattttttcagacataaagtgcggtcggttttttgatagttttgaataatgcctattttagcatatttactgtgtaaaattgatcaggcaaaaatctaagttttacacagacttagcgatgtcaagaggaagatgtcacaaattcattaaaaaaactttaaatttttactagacaaaacttaacttattgattttaaattaaaatttaattttaggctaatctataatcaagatcgaataatccttgtaagaacaagggatccgcaaaattttaaaaagttaatccacaaagttatccacaggctctgtggatagaaaaataaatattagggggtatataaaagatgagaaaatttttatttttttatgaaatttttttaaattttgcattgacaagctaactatcgatcattaaaattcgcgccctgttcctcgtgatacaaagtttattcctccttagttcagtcggtagaacggtggactgttaatccatatgtcgctggttcaagtccagcaggaggagccaatttttcttttggtttagagtttgtttgtctccttttacaaattctaaattagcaaccaaaagattttgagcccatccagttgatgggctttatttttaacttcaaaataggattttgcttccgccagttgagatggttgtgccgtataacaaactcagggcaaaaaatagcattattccacctgcgattagtttcacgatgctttcgctttttcctttcgtattttttgaactataccaatgccctaagtggattgcggtatttcgtgcataacgtacaattcctgcgaaggctgacagcataagccctgtgccgaaagacatggctaatacagctaaaattccccagctataaagatcaagcatataagctaaaaataaaacgaaaatcgcaccgctacaagggcgcataccaattgttagaatcacgaggaattgcgattttagattggttgcttgtgcagtttgcgtcgggcttggcaaatgttggtgtccacaactacaggtgtttggctgaaaagtgcggttatttttcaccgcacttttttcgtgtagagggaggggattgagggatttaatggctaatttagcttttttacgataggcacgtagaccttgccaaatccaataacagccgagaaataccaataatagcaaggcagttcgttctaaccaaagctgacttaatttgaaataacgtgatgaaagatttagcactacaacaagcaatgttgttgctgtaatcgcgacaatgccttgcattaaggatgaaagtaagctcaagatagtgctttgttttaattggctttcatgagtggaaagatagctggcaataataaatttgccgtgtcctggcccgagggcatggagtacgccgtaaacaaagctggcgaaaataagtgtggtgcctgccttgatgctattattttgaatttgatgtaaattttccgaaataagctgattaaactctttttgccaactggcaatatgtaagaaaaaccaaggggaaaaatagacaagtaaggcgagtgcaatcactaataacacgagcccagttttatatttttncatttctactcacattgaattattattttttgcgcgaacattacgcctaaggaatcatcttcgttcttttgggatttatcaagtgaagatgcgtaggcttggattttttcatccacattaggttcaattaattttccttggcaatttttcgaaagtgcggaaaaatctaccgcactttttgaagcgtaagtcatcgccacataataagtaggatcgtaagtttgtaagctaaatgtgtttttttctaacttttgcggatgggcgagtggcacatcaaaataatattgcagttgtaagccttgaacattaatgccgtaattttttgggcgaggggaatatttgattttattattctgagcatcatatagatagctgaaataatgttcactgacgatatttcccatcacatcatcaagaagtttttgtttttccgctttagttctagcttgtttcatatcataaataactgcagacgaacttggttcatccaacgtccatttcattgaaaaacctgtgagttgattattttctataatgggcgtggtttgtatatcaataaatgcgtgaggatgggctaaaacaccaaaactaatgaataaaccgagtaataatgaatacgttttcacaaaaaatcctattattttgaacgctagaatttgaagttgtttattctacacgcaaaaacgaatttttctgtcaaaaatgttgatgtaaatcaaaaaaactctcaatagcatttcccttgcctttcaatattcagtaacatagctcccgtcaagtgattgcttgatattcataaagttcctaaataaaataatgataaatatagctaaactactktcctgccacccgtttcgggtggttttttttatctaagtcgaaagatgcactcttgcattgtgcatttattcttattatgatcagctcgagtataactaagagaataatagatgtttaatttaaagcgtgagcattttagagatgattatctttataggttttatcaatatggtgatactcatagtaagattccttctaatttgtataaagtattggcaagaaaattagatatgataagtgcctcagaaaatatcaacgatttacgttctccaccagctaaccatttggagttgcttgagccaaaagaaaataaaatttattccattcgagtgaataaacaatattgtttaatttttaaatatgaaaataacgaagtaaataatttatatttagatccacattcttataatttgtaaggaggataatatgatgacgagaaaacccacctctgttggtgaaattctacaagaagagtttttagaacctttaagtcttaaaattagtgatttagctcaaattttagatgtacatcgtaatacggcaagcaatattgttaataatagttcacgaattacgctagaaatggcagttaaacttgctaaagtatttgatactacgcctgagttttggcttaatctgcaaacacgtattgatttatgggaccttgaacacaataaacgttttcaacaaagtcttgcaaatgttaagcccgctctacatcggcatgatacttctacatttgcaatgtaatttgagccctaaagtgtctatttaatttagggaatacttcactctaaatatttacaagtggttaggtttcgccaaacttttgcaaaatctgtccacttgtttcctatatttcngccctattttccagtagaatagggcgaatttttttgtgaggaattattaatgtcatctcaatttgtgtatacgatgcatcgtgtcggcaaagtagtgccgccgaagcgtcatattttgaaagatatttctttaagctttttccctggtgctaagatcggggttttaggtttaaatggtgcgggtaaatcgactcttttacgcattatggcaggcgtagataaagagtttgaaggggaagctcgtccacaaccgggtattaaaattgggtatcttccgcaagagccaaaactcgagccacaacaaaccgtgcgtgaagcagtggaagaagcggtttctgaagtgaaaaatgcactgactcgtttagatgaagtgtatgcgctttatgcggatcctgatgcagattttgataaattagcggcagaacaagccaatcttgaagccattattcaagcgcatgatggacataatttagataaccaattagagcgtgctgcagatgcgttacgtttacctgattgggatgctaaaattgaacatttatctggtggtgagcgtcgccgtgtggcactttgccgcttattactcgaaaaaccagacatgctcttattagatgagccaactaaccacttagatgcggaatctgtggcatggttagagcgattcttacacgactacgagggtacagtggtagcaatcactcacgaccgttatttcttagataatgtggctggttggatcttagagcttgaccgtggcgagggcattccttgggaaggcaactattcttcttggttagagcaaaaagagaaacgcttagaacaagaacaagcaactgaaaacgcacgtcaaaaatccattgcgaaagagttagaatgggttcgtcaaaatccaaaaggtcgtcaagcgaaaagcaaagcacgtatggctcgttttgatgaattgaactctggcgaatatcaaaaacgaaacgagactaacgaactctttattccacctggcccacgcttaggcgataaagtgattgaagtgcaaaacttaaccaagtcttatggcgaccgtactttaattgatgatttatcattcagtattccaaaaggtgcaatcgttgggattatcggggcaaatggtgcgggtaaatctactttattccgtatgttgtcaggtcaagaacaaccagattcaggttctgtgacaatgggcgaaaccgttgtacttgcttcggtagatcagttccgtgattcaatggatgataagaaaaccgtgtgggaagaagtgtctaatggacaagatattctcactattggtaactttgaaattccaagccgtgcttatgtagggcgtttcaacttcaaaggcgtagatcaacaaaaacgtgtgggcgaattatcaggtggggaacgtggtcgtttacacttagcgaaacttctacaacgtggtggtaacgtgctattactggacgaaccaaccaatgacttagatgttgaaaccttgcgtgccttagaaaatgcgatcttagaattcccaggctgtgcaatggtgatttcgcacgaccgttggtttttagaccgtatcgcaacgcatattttagactacggcgatgaaggtaaagtcacgttctatgaaggtaacttctcagactacgaagagtggaaaaagaaaaccttaggcgatgcagccactcagccacatcgtattaaatataaacgtattgcgaagtaatttagattgagaaagtgcggtgaattttgaccgcacttttcttacttttttgggagtgattatgttagttcatttacatatttttttcgcctttttaagtttggcattgttagtaattcgtggtgcaatgcagcttaatggtaaaaattggcgttcgataaaattattaaaaattttaccgcacttatcagataccttgctgattgtgtctggtgtcgtcattttatacctctttgcttttggtattgaatggtggttagtggctaaattcgcattactgattttgtatattgtgtttgctgcaaaatttttcagtaaaaaagtttctcaacccaaaagcatttncttttggcttgcttgcgtaagttttattggtgcgatgttaattgcctatttaaaataaaacgatgccatctcgccagcttcaaattttaatcagaaaaactttgccgcttgtgcctgatcacgtattaattatcggcgaaagtggcattgcttttnctaaagcaacgaatttgctcgggcaagaatttgaacatattttatttgatggacgaaatggcattcatcttgaagcactggctattgcagctggaacactgaaaatgggcggcacactttgtttagtgttatctgattgggaaaatttatctcagcagcctgatcaagatagtttacgttggaatggaaatcagtcagctatcgccacgcctaattttatttatcatttcaaacagtgcattgaacgttatcatttccccattttaagagaggaaagtgcggttgaatttcctacggttttttattctaacgaacatcacaaaaatgctacgttagcgcaacaacaaattatcgagaatattttacaggccgagcaggatatttattttctaaccgccaagcggggaagaggaaaatccgcattattgggtatgcttgctaaccaaattcaagcaccagtttatctcaccgcaccgaataaaagtgcggtgcattccgttattgaattttcagaaggggacattgaatttattgcgccagatgaattggctttgacgttacaaactgaacccgaatttagtcaatctgcttggttgctggtagatgaagcggcgatgatcccattgccgttattgcaagaatattctcgatattttcaacatattgtctttagtactacaattcatagctacgaaggtacggggcgtggtttcgaattaaaatttaaacggaaaattcaccgcacttttcagcattttgagcttaaacagcctctacgttggcaagaaaatgatccgttagaacattttattgatgatcttttattgctaaatgccgaagatgattttcagcactttgactatagcaatattacttataacatagaggaaaacgctaaaaatctttscttcccctgcttgcgggggaaggtgcccsaagggccgaaggggggatttagatatagctagcctccctcaagctttggaggctctcctcacaagtaaggggagtgaaggaaaatataatcgtcaatttttctttcgagatttttatgggctaatgacgattgccactaccgaacatcgccactcgatcttcgtcgtttactggatgggaaaaatcaacgtttttattttgctgaatatcaacagaatttgctcggtgcaatttgggcattagaagaaggaaatatggctgatgatgagttgattattcaaattcaacaaggcaaacgtcgcccgaaagggaatcttgtgccacaagccttgtgtttccacgaaaatctttcccaagcctgtaaactgcgttcactccgcatttcacgtatcgccgtgcaaccaaattggcagcaaaagggcattgggcaaaatttgatgcaagccatggaaaatgccgatgtggattttcttcagtgagttttggctacaccgacgaactcgcaaaattttggcaaaagtgcggttttgttttggtgcatttaggcgagcatcaagaagcgagtagtggttgttattcagcgattgcccttaaaggtatttccaaagaaggcttggctttagttgatactgcgtacaaacaattccagcgtaatctccctttatcttttcatccgtttgccataaattttgagcaaaatcagcttgattggcagcttgatgattttgattggatgagcttaaaaaacttcgctaattttcaccgcactttattttcgagcattcctgcgatgaggcgtttattaaaattagcaggcaaagaaaatttcccattaatttccgcttatttaacaaaaaaacaatttcctattaacaagaaaaaaggcgtagaatgtttgcgtttagaaattaaacaatatttagagcgaggaactttatgacagaacaagccgcaaaaccaaaaggctggtttaaacgcgcacttgaaaaatatgacaacttcattaaagaatggggtttagatcaaccgaattgtagctgcgtgcctatgtcagcaacagaagatgaaaatggtaatttgaagaaaaaagaatcttctttaaagaaataaatatcaactgtttttttaaacagttaaattattgaaagatagagcaaattccagtacactatgcctcaattttacacaagattgacgcattatttatatttatgaaaacggcttttttccaacctgatattccaacccaacccaatgatcacaaaattttaggcaatgtattaccaggagctgatgcattggcgattagtgaaatttcagagcaaaatcaaaatttaaccgtagtggtaacaccagatacacgaagtgcggtgcgtttatcacgtgttttatcggaattaagcagccaagatgtatgcctttttcctgattgggaaaccttaccttacgatactttttctccccatcaagaaattatttcctctcgtttaagtgcgcttttccatttacaaaatgcgaaaaaaggcattttcttattgccaatttcgacattaatgcaacgcctttgcccgccacaatatttacaacacaatgtgcttctgattaaaaaaggcgatcgtttggtcatcgataaaatgcgcttacaattagaagcagcgggctatcgtgctgtggagcaagtattagaacacggcgagtacgcagttcgtggtgctttgttggatcttttcccaatgggaagtgcggtgccttttcgccttgatttttttgatgatgaaattgattctattcgcacttttgatgtggatacgcaacgcactcttgatgaaattagctcaattaatcttttgccggctcacgaatttccaacggatgataaagggattgaattttttcgtgcgcaatttcgtgaaacttttggggagattcgccgagatcccgaacatatttatcagcaaatcagtaaaggtaccttgatttctggcattgaatattggcagccacttttctttgctgaaatggcgactttgtttgattatttgccggagcaaacgctgtttgtagatatggaaaataatcaaacgcaaggcgagcgtttttatcaagatgcaaaacagcgttatgaacaacgtaaagtggatccgatgcgtccgcttttatcgcctgaaaaattatggctcaatgttgatgaagttaatcgccgattgaaatcttatccgcgcattacatttaaagcggaaaaagtgcggtcatcggtacgccagaaaaatttacctgttgccgctctaccagaagtgactattcaatcccagcaaaaagaaccattgggacaattacgtcaatttattgagcattttaaaggaaatgtactgttttcggtggagacggaaggtcgccgagagactttgcttgatttgctttcaccgttaaaactcaagccaaaacaaattcaatctttagaacagattgaaaatgaaaaatttagcttgttagtcagctctcttgaacaaggttttataattgaacaatcgcttcctgttgcgattattggcgaagctaatttacttggcaagcgcattcaacaacgttctagagacaaacgtaaaacaattaatcctgatacgcttgtacgaaatcttgccgaactgaaaatagggcagccagttgtgcatcttgatcacggtgtggggcgttatggcggtttggtcaccttagatacaggtggcattaaagcagaatatttgctactaaattatgcaaatgaatcaaaactttatgtgccagtgacttcattacatttgattagccgttatgttggtggttctgatgaaagtgcaccattacataaattagggaacgaggcttgggcgaaatcacgccaaaaagcagcggagaaaattcgtgatgtggcggcagagttattagatgtttacgcacaacgtgaagcgaagaaaggctttgcctttaaatatgatcgtgaagaatttcaacaattttccgcaacctttccttttgaagaaacctacgatcaggaaatggcaattaatgcggtaatttcggatatgtgtcagcctaaggcaatggatcgccttgtttgtggtgatgtgggttttggtaaaactgaagtggcaatgcgcgctgcctttttggctgtgatgaatcataagcaagtagcagtgctagtgccaaccacactgttagcccaacagcattatgagaattttaaagatcgttttgcgaatttgcctgtgaatgtcgaagtgttatcgcgtttcaaaactgcaaaagaacaaaaacaaattctggaaaaccttgcagaaggcaaagtcgatatactgattggtacccataaattaattcaatcagatgtaaaatttaacgatcttggattgttgattattgatgaagaacatcgttttggtgtagggcaaaaagagaaaatcaaacagcttcgtgcgaatatcgatattcttacgctaacggcaacgcaawtcctcgaacgcttaatatggcgatgaatggcattcgtgatctttccattatttccacacctcctgctcgccgattaagtattaaaaccttcgtccgtcagaatgacgatcttgttgtacgagaagcgattttgcgtgaaattctccgaggtgggcaggtttattatctccacaatgatgtcgcgagcattgaaaatacagcagaaaaactgaccgcacttgtgccagaagcgcgagtaattgtaggccacggacaaatgcgagaacgtgaattagagcgcgtgatgagtgatttttatcatcagcgttataacgtcttagtttgttcaaccattatcgaaacgggtattgatgtaccaacggcaaataccattattattgaacgagcggatcattttggtttggctcagttgcatcaattacgtggacgagtcgggcgttcacatcatcaggcttatgcttatttgcttacgccaccgccaaagatgatgacaaaagatgctgaacgccgtctagatgcgttggaaaatcttgataatcttggggctggttttatcttggcaacccacgatttagagattcgtggtgctggtgaattacttggaaacgaacaaagtggacaaattgaaagcatcggtttttcactttatatggaattattggatgcagcggttaaagcgttaaaagaagggcgagaaccatcattagaagaattgacgcaacaacaagcggatattgaattgcgtgtgcctgctttactgcctgatgattatctaggcgacgtgaatatgcgtttatccttttataaacgcattgctgcagcagagagtaaagcagaattagatgaattaaaagttgagttgattgacagatttggattattgcctgatgcaacgaaaaatttattacaaattacagagttgcgtttattggttgagccgttgaacgttgtgcgaattgatgctggaacacaaggcggttttattgagttttcagcaaaagcacaagtgaatccagataaatttattcaattaattcaaaaagaacctattgtgtatcgatttgatggcccattcaaatttaagtttatgaaagatctatccgataacaaagtgcggttagaatttgtggtggatttgttaagaacgattgctgcataaaaagaagcccgatcattgtgatcggacttttttcttaaatatatcaagcagattattgcactaataaatagaaattactgtcacctcgtaaaatattaagtgcaactgctgacggttcagtttcaagcactttatttaattcacgaatgttttcgatcatttgacgattaataccaataataatatcgcccgattttaaaccacgttgtgcagctagcgaattaggttgaatttttgtgatttcaattcctttaacgcctttagcatcgtagtctttcaatgttgcgccatctaatgcaggcaactcagtttttgaggaaagttggctactatcatccgcttgtaatttcattttaacgtcgtgggatttgccatcacgtaagtaagtcaagctaatctctttgcctgcaccagtggttgcgatttttgcacgaatttcagcgaaacttgagattttttgaccgttcatcgccgtgataatatcgcccgctttaagtcctgctttttcagcagcagatttcggtaaaacttcacttacaaatgcaccttgttgcgcgcttacattaaaggctttggctaaatcagcattgagttcgccccctttaataccaagcaatccgcgacgcacttgaccaaattctaaaatttgttgcactaaattgcttgcttgattacttggaatcgcaaaggcaattcctgcattgccaccgcttggagaaataattgcggtattaattccaataagttcgccatttagattgactaatgcaccacccgaattacctcggtttactgctgcatcggtttgaatatagttttcataagtgccactgtcagaacctgttgaacgacccaatgcagaaacaatacctgatgtcacagtttgacctaaaccaaatggattaccgattgcaacagtgaaatcgcctacgcgtaatttgtcggaatcagcaaatttgatttctgttaaattacttggtttttcaagctgtactaatgcaatatctgattgttcatccttacccactaattttgctttaaattcacgcccatcttgtaattgcacggtaattttatcagctccatcaataacatgattattggttaaaacatagcctttgcttgcattaataatgacaccagaacctaaaccacggaagttacgctttgattctccacgcccaccaaattgttcggcaaaacgatcgccaaagaagaatttaaattcttcaggaatatcgtctaggaaaggagaacgagaatctactttagcttttccttcaacggaaagagtgacaacggcaggttgtactttttctaacatcggtgcaagactgttttgttctgaaacaaaacttggcaaagtggcttgagcaacatgagcaacaaatgatgtgcntaatacacttaatccaagtgcaatactatttaatacaaaacgtgtttttttcataaatactccaaaataaatttcagataacgtggtctgtaagacaaaaaaataaaaaaaatgttcaataagaggagagcaaattatcttgtttaaaaggaaatcggagcagtacaaaaacggtcttacaagtagcaaattctataaatttatgttctaatacgcgcaattttctagtcaataaaaaggtcaaaaaatgagctggattaaccgaatttttagtaaaagtccttcttcttccactcgaaaagccaatgtgccagaaggcgtatggacaaaatgtactgcttgtgaacaagtactttatagtgaagaactcaaacgtaatctgtatgtttgcccgaaatgtggtcatcatatgcgtattgatgctcgtgagcgtttattaaatttattggacgaagattcaagccaagaaattgcggcagatttagaaccaaaagatattttaaaattcaaagatttaaagaaatataaagatcgtatcaatgcggcgcaaaaagaaacgggcgagaaagatgcgctaattactatgacaggtacactttataatatgccaatcgttgtggctgcatcgaactttgcttttatgggcggttcaatgggttctgtagttggtgcaaaatttgttaaagcggctgaaaaagcgatggaaatgaattgtccatttgtgtgtttctctgcgagtggtggtgctcgtatgcaggaagcattattctctttaatgcaaatggcaaaaactagtgccgtacttgctcaaatgcgtgaaaagggtgtgccatttatttcagtattaacggatccgactttaggcggcgtatcagccagttttgcgatgttaggggatttaaatattgccgagccaaaagccttaattggttttgcagggccacgcgttattgaacaaactgtgcgtgaaaaattgccagaaggtttccaacgtagtgagtttctacttgagaaaggggcaattgatatgatcgtgaaacgttcagaaatgcgtcaaactttagcaagtgtactgagtaaattaacgaatcaaccttctccttttgtagaacctgaactcatttcagaagatgaataatatgcaacttaaagccacttcgccactcgctgagtggctttcttatttagaaaaaagccattttaaacctattgatctcggtttagatcgtattaaatccgtagcggaaaaattggatttacttcatcccgtcccttatgtgataactgtgggggggacgaatggtaaaggcacgacttgtcgcttgttagaaacgattctgcttaatcacggattacgtgtaggcgtgtattcttcaccccatttattgcgttataacgagcgagtacgcattcaaaatcaagatttacccgatgaagcacataccgcctcttttgcttttattgatgaaaacaaaacagaatcgctgacttattttgaatttagcaccctttctgccttgcatttatttaagcaagcaaaattagatgtggtgattttagaagtggggttgggcggtcgtttagatgcgaccaatattgtggatagccatcttgctgtgattactagcatcgatattgatcacaccgattttcttggggataccagagaggccattgcttttgaaaaagcaggaattttccgcgaaaattgccctgtcgtgattggtgaacctaatgtgccacaaacaatgttagatcaggctgaaaaattacattgccaagttgctcgtcgtgatgtggattggttatttgagcaaaatgctgaaaattggcaatggcaaaataaaaaagtgcggttagaaaatttgccgttttgtcagattccattggcgaatgccgcaacggttcttgctgctgttcaatatttaccttttgatatttcagaacagactttgcgaaaatctttgcaagaggtagaactggttggtcgttttcaagctataaaaacagataaacgtgagaaattagcggattatcttggcgtaccagttgaaaccttgccaacaatcatcgttgatgtggggcataatcctcacgctgcaaaatatttatctgaaaaattgaccgcacttaaacgtagcatcgagggcaaaatgattgccgtgtgtgggatgctcaaagacaaagatgcaaatggggtatttgagcatttaacacctattattgatgaatggcattgtgtaactttaggcggttatcgcgggcagtcaggcgatgaattagtagagaaattgaaaagccatttcccaaatattcaagctacatcagataattctgtcatggatggtgtgtgtacagcactcaaaagtgcggtaaaaaatgatgtggttttagtctttggatctttccacaccgttgctgaattttgggctgtggtggaataaaatttatcattaaaacaaagggctgatatttaaaatcagcccttattttttggaatattatctccaagaatatttcacacccacggtgccttggtagcctttatgactatttttttctctgttttatcttttacatcaattgtgagttcaacgacaattaaagtaaaccctttagcataaaacagtattttccttatcggttggattttaaccagtttgtgtttatttaacaagtttagattagtgtgattttagaaaaatcgaagaaatatgatttagaacaatatttataatgtggtgctgtttggcaatggctgaggttcccctaaaaaataaggctcaacacctaatatcaagtcaaaaaccgcttttatgcgggcaaaaacttctcttatttgtgtggaaaaatgtaattctggctgttttgccacaaagcaaatggcatcaatattatgtgcttgggcaattaatagcgcgcgttcgcaatgaaatttttgactgacaatcgtaaatgttttcacttggaaaattttatcggcgcggataacggaatctagggtgcgaaaacctgcaaaatcacggaacattaaagtttttggcacgcccattttgcgtaaatcgcgaaacattgctcttggttcgttatattgcaaagttcggttgtcgccacttaataaaagataattcactttttgttgttcgattaggcttttagctgccattaagcgactatcgtaataaacgttcggttttccgctgacggtgtattttgatgtgccaagcacaagggcgcaggggcgaaaggggagttcatcaatatttgtgaatattttatcgcgaacataaaaactgatgcctcgatccactagcaagcaaagtataatcaatgcaaagattgcgtagagtagtgtgcgaaaaagtgcggtaaattttggggagaatttttttactagcatagtggtaaacataatgaaaaatcgaccgcacttcaaggagaatttgatggattttgtgaatcgcattgatgtgcgataatttagccgtttagacggctaaaatttcttgacaagctaatcgacttactgatagtttaaacgccattctgattattacgataggttttcaatgtctgtgcaaaatgtagtgctttttgacacacagcctttaactctgatgcttggcggcaaactttcccatattaatgtcgcgtatcaaacttatggcacgctcaatgccgaaaaaaataatgcggtattaatttgccacgctttgactggtgatgctgagccttatttcgatgatggtcgagatggctggtggcagaattttatgggagcaggtttagcattggatacggatcgttatttttttattagctcgaacgtattaggtggttgcaagggaacaactgggccttcatcaattaatccgcaaacgggtaaaccttatggcagccaatttcctaatattgttgtgcaagatattgttaaagtacaaaaagccttgcttgatcatcttggtattagccatttaaaagccattattggtggatcttttggcggcatgcaagcgaatcaatgggcgattgattatcctgattttatggataatatcgtgaatctttgctcatccatttattttagtgctgaagccataggttttaatcacgtaatgcgtcaagcggtcattaatgatcccaattttaacggcggcgattattatgagggtacaccgccagatcaagggttatctattgcacgtatgctaggtatgctgacttaccgcaccgatttacaacttgcgaaagcctttgggcgtgccacaaaatcagatggcagcttttggggcgattactttcaagtggaatcctatctttcttaccaaggcaaaaaattcttagaacgttttgatgccaatagttatttgcatttgttacgtgcgttggatatgtatganccaagtttggggtatgacaatgttaaagaggcattatcacgtattaaagcacgctatacgttggtttctgtgacaacggatcaactttttaaacccattgatctttataaaagtaaacagcttttagagcaaagtggagtcgatctacatttttatgaattcccatcagattacggacacgatgcgtttttagtggattatgatcagtttgaaaaacgaattcgagatggtttggcaggtaattaattagtcataaaaangtgcggtgaaatttcaccgcattcttcttttataaccagttattcttcagaactgctttcttccaaagaatcatcttcatctgcatcacaaacacgttctaaacttactacgtgttcatcatcggcagtacgaattaagcgaacaccttgcgtgttacgccctacaatgctcacttcgcttacgcgtgtgcgaacaagggttcctgcatcagtgatcaacataatttggtctgtttcttctacttgagttgcggcaacgactttaccattgcgttcactcactttaatcgaaatcacaccttttgtattacgtgatttagttgggtattcacttaattgtgtgcgttttccgtagccgttttgcgttgcggttaaaattgccccttcaccttttggcacaacgagcgagaccactttatcgatatttaagtctaatgatgcttcagcgttgtcatcagaaatatcttcaatttctaccgcactttcatcgtcagaaatatcgtttgttaaagccagtttgataccgcgaacacctgttgctaaacgccccatcgcacgcacggcattttcagcaaaacgcaccacgcgaccttgtgatgagaacaacataatttcgttgctgccatcagtaatatccacgccgattaattcatcttcgtcacgtaaattcaatgcgatgataccgtttgaacgtggacggctaaattcggttaaggcgattttcttcacaataccgccagcagttgccatgactacgaatttatcttcttcgtaagcagaaactggcaagattgcagtaatacgttcgttttcttgtaacggaagaatattcacaattggacgaccgcgtgcgccacggctcgcttgcggaagttgatatactttcaaccaatataaacgaccacggctagagaagcagaggatggtatcgtgagtatttgctaccagtaatttttcgatgaaatcttcttctttcatcttcgttgcagatttgcctttaccgccacggcgttgtgcttcatagtcagtcagtggttggtatttcacataaccttcgtgagaaagcgtyacaaccacgtcttcttgtgcgattaaatcttctaaatcaatatcgccagaagcagcggtaatttcagttaaacgatcatcaccaaattgtgcttttacttcttccaattcttcacgaattacttccattaaacgttctgcactacttaaaatatgaagaagatccgcaattttaactaataattcttcatattcttttataacttcttcaaacgcaatgcccgttaaacggtgtaagcgaagttctagaattgcgtttacttgcgctggcgataagtaatattgttcgccttgaataccaagattttcttctaactcatcaggacgagcagaagcatcaagaagattaataatatcgctatgtaacgtccaagagcgtgaactgattgatgttgcggcttcttcacggtttttagagttacgaatgatcgcaatcatttcatcgatattagaacgagcaaccgctaaaccttccaaaatatgcgtacgttcacgtgctttgcgaagctcaaagatagaacgacgtgtaaccacttcacggcggtgtaaaacaaaggcttcaataatttctttaagattaaataaacgtggctgaccgtgatccaatgccaccatattgataccaaaggtcacttgcatttgagtgagtgagtaaagatggtttaataccacttcccccactgcatcacgtttaatatcaatttcaatacggatcccttctttatttgaaaggtcagtaatattgctgataccttcgatttttttctcgcgaattaattcggcgattttctcgactaattttgctttatttacttggtatggcaattcagacacgataatttgctcgcgtcctttttcgttggtttctaccgttgcacgagcacgaacatacactttaccacgaccagtgcgataggcctcttcaatccctttacgaccattaattaacgcagccgttgggaagtcaggccctggaatatgttgcattaattcatcaatggtaatttcatttttgtcaatataagccaaacaaccatttaatacttcgtttaagttgtgagggggaatgttagttgccatccccaccgcaataccagaagaaccatttgctaacagtgctggaatacgagtcggcaatacatctggaatcattaattcgccatcatagtttggcgagaaattgacggtttctttatccaaatccgtgagcaatgcttgcgtaattttttgcatacgtacttcggtataacgcattgcagctggcgcatcaccatcaattgaaccaaagttaccttgcccatcaaccaacatatagcgaagtgagaagggttgtgccatacgaacgatggtatcgtacacggcggagtcaccatgcgggtgatatttaccgattacatcacccacaacacgcgctgattttacgtattttttattggcggtattgccttcgcgatccattgagaatagtacgcggcggtgaacaggttttaaaccatctcgaacgtcaggtaatgcacgcccaacgataaccgacatcgcgtagtcaaggtaggaagatttaagttcttcttcgatattgacaggggtgatagatgattggattgaatccgtcattggtattccttttttgatcaaaaattgtggcggattatagcataaaattgtggatatgtggtttttgatatcaggatttcgcctgatggcgccttactttttctttgcttcgccaaagaaaaagtaagtaaaaagaaaggcgaccctacttttccttgtttcctttgttccattgaatttccttaacggaaattgccggacctggctacgctcaaacagacgaaaatttcctacaaatncaattccacaaaggtggaaaagaagggaacccaattnntcctttatccgatttaaagtgcggtcaaaactcaaaatatttttggtccttaaaatgaatttaaaattaaccgcactttttaaataatgctctgataaattcggggccccatataaatcgcctttgcgactttcaatttttaggcaatttgcgtctgtttgagcgtagcgagttcagcaaatttccgttaagaaaattgaaacaaagcaaagaacagcgatttaactggggcgtgttttctttgcctactttcttttacacgagtaaaagaaagtaggtcgtcgtcaggcgaaatcctgacctaattatttccaattttcttttttggctttctgcaacttcccataagcccccaacaacgcctgatgttccttaaagtttttcaaattttcatcacttgcaggaagattgtagaacggattgccaccttcagagacagcagcccaagcttgtttaactgcatctttaccatacattttctcaaatactgcacgatattgtgctgggtcgcgattttgatctaaatgtaattcaatgatggaaattaatgtgcggtaataattcacaggttctgtagtgaatacggagctgttcatattcagcgtccagtttgcccaatctaatgcctgttctaattcgcctaatgcaaggtggagcatagattttaattcacccacgcgtaaggttgtccagccgctatttttaggtgcaacgatgccgataaattcacgcacgcgagtcgcatcgtcaatatcttgcccatctaattcttctaataattcttgataggtttctgcatcgtgatgccagtttggtaaatccagtaaaatttcgcgccaatccattcccatattgttgttggcataaattaaatcgtctgcaggataaatatcagacatgcctggcacaataatacggcacgcatagacatccaaatggttgtaatccattacgtaaacttctttttcatccgcacggaaaattgccattaaattattgtattcttcctgtgttgtaccactgaaatcccaatcagcaaattcataatcaggcgtttctttgagtaaatcccaagaaattaaaccgcttgagtcaataaagtgggtttctaaattagcgtgttcagccacatcatcgttattgaaagagggcggagagaaaacatccaaatctttcaagctacgaccctgtaaaagttcagtcacagtacgttctaatgccacttggaaatttggatgcgcaccaaaagaggaaaagcacgtgccgttattcggattgagtagcacaacgcaaataacaggatattttccgccaagtgaagcatcaaatgcataaattgggaaaccttcttcctctaattttgcaatagaagcctgaatagatggatagcgatccatcacagattttggaatttctggcagactaattgcttcagcgataattttgtttttcacataacgctcaaaaacttctgacaagccttgcacgcgtgcttcaaattttgtattgcctgcagacatgccatttgaaacataaaggttagcaataatactttgtggaatgtaaacggtttgttcgtccgattgacgaacataaggcatcgccacgatcccacgatcataattgccagactgtaaatcgactaataattcaggcgtaagctcggcattaggatnaaaataatccaataaataatcatctnaaatgccattaggcagtaaagcatcatcttcaatcgggaaccatttttcattgggataatgcacaaaatcgctgtttgcaatttcttgtcctaaatagaaatcggcaaagaaataattagtggaaagacgctcaaaatattcaccaagggcagaggctaacgccgcttttttacttgcccctttaccattagaaaaacactgcggacagtctttatcgcgaatatgcacagaccacacatttggcacaggattcaaccaagatgcctcttcaatattaaaaccaagtgcggtcaatttttgctgaaattttgcaatactatcttctaatgcggcatctttgccgagaataaaggtttgttctgtcatttttgttcctaaatgagaaaaaagtgcggtgaataataggggagttttaatagcggagcaagattttttcggcaaaaataaaccccgaaaaacttcggggttttctaccgcacttttaacgtatatttgattggcgttaaagtaaagttggattgamccgcacttttaaggcaattgtaattgcggcgaaaattttttcatcgttgagaggaaagttttcgcgtaaagtgcggtgggaatcagttatgtttatttgagcttgtgataattcatttaataaaatcgggagagaaagattgagctgctcggcgatttgttgaatagaaaaatgctcgaaagtcatcatcaagcgatctaaattgcagtaagaaggcatacgattatgcgtgatgagatcggcaaattgagtgttgatttttatccatttcttcttacggctataaaaatgcagtaacaaaccaaatacggtaaatccagcaaagattaggtaaattgcttggtaacgaaaaacaagctgaagcacaagctaaatatgcggaagacacgctgaaacaagcacgcgattttgctaaacaacatcataaaacagcctatttagcgcgtaatgcggatggcttacaaactggtcaaaaaggttcgattcatacggaagcaatggaattggttggcttggaaaacgtcgcagagggagaacaaaaaggcttaactcaagtttcaatggaacagcttttattgtgaaatcctcaaatgattttcacccaatatgatgagttttataaagtgcttgaaaacaatccgcagtggaaagaattaagtgcggtgaaaaatcagcaagttttctttgtgccgcatacaccatttggttggattgattcgccaccgagtttaaaccgtttattaggcgtgcgttggttacacatatgttgaatggtaaggcgaatgctgactttgtgcctgaaatgcaacgtttctataaattgttctatcacattgatttaaccaatgaacaagcacttaagttgtttcaagtaaaatgatgagatcgacttttcttttacgttcgcctcgtttgttttttgtcttgttagttggattgttacttggcagtattttacttgctttgaatgtggggaaatacccgctttcgcctagccaactttgggagacaataagctgttcgtttagcgggcaatgtgaaggaaatacggaacaaacagtactgtagcaaattcgtttgccacgtatttttgccgcttgttttgtcggggcggcgcttgcttgtgggggcgcaacttatcaaggtatgtttaaaaatccgcttgtttcgccagatattttgggtgtttcagcgggggcaggttttggggcaagtttggcaattttttataatttgccaatgatttatatccaattttttgcttttagcggtggcattttagctgtgttatgtgtatcgctcattgcctcgcgtagtcgtacacaagatcctattttagtgctggtgctttctgggattgcaattggttctttacttggtgcaggcatttctttgttaaaaattcttgcggatcctttcactcaattaccttcaatcactttttggctacttggtagcctgacggctattaatcaacaagatttaattcaattgatcccgatgttgttgctagggattgttcccatttttttattacttactgatacgctggctcgcacgattgcaccgattgaactgccactcggtattctgacttctgcttgtggttattagtgcgagggcaaaaataatgttactcgaaacccaaaatcttgccattggctatgaaggaaaaacactggttcaacatatccaatttaccctagaggaaaatcaaatttgttgtttgcttggtgcaaatggtgcaggcaaaagtacgtttttgaaaactttacttggtttacaaccgcctattggtggtgatattgtttggcaaggaaagtcgctttctgattattcaccaacagaattggctcggcatattgcttatgtgccacaagcgcattctcatttatttccttttttagtgcaggatatggtgatgatggggcgatctgcttttttgaagtggtatcaaactccgaaaaaatctgatttggatttagcattaatggcattgcaagagttagaaattgctcatcttgcgcaacgttattatcatcaattaagtggcggcgaaaaacagcttgtgttgattgcccgtgcgattgctcaacaagccaaacttttaattatggacgaaccgacttctagccttgattttggtaatcaaattcgagtgttagaaaaaataaaacaactgcaaaagcaaaatattgcgcttattattagtacgcataatccacaacaagcggcatttttaggggataatattgttttgcttgatcaacaatttggctttcaacaaggcgataaaaaacatttattaaccttagaaaacttggcgaaaatttaccgcacttcgcccgaacttttacatcaacatttgaataaccacattgaaaaatcactatgactatttacgacatcaattttgctgaactttatcaacaacacttaatcgcttgtaatcattacaacttacctccgataaaatgggataaaaaagctgtgaaaatggcagagaatttagtcggaaaaccttctgcatataatcagcaattattgcaagctatgaatgtgcaaaccgatgaagctgtgttggatattggctgtgggcctggtacttttgctgtgccgctcgcacaacaaggctcaacggtatatgctttggattatagcaatggaatgttagactgtttggcacaatttaagcagaaatttggtttgcatcatctcacgacatttcataaatcttgggcggataattgggatgatgtgccacaagctgatgtagtgttggcatctcgttcaacgttggtggacgatttggacgatatgattgaaaaactctgtgccaaagcgaaaaaacgtgtgtttttgacttctgtcacacaacgccatttcttagatgagggcgtatttgaggcaattggccgtgaagatattggtttccccacttatatttatttactcaatcggttgtatcaaaaaggcattcaggcaaatttgaattttattgaaacggaatcgggttgttttcaaggtgaaagctacgaggatttattagcctcggtggagttttctttaggcgagctttccgaaaaagaaaaacaaggtttgaaagccttttacgatcgtaaacaagccaataacgaacccatttctcacggacagaaaaaatgggcgttaatttggtggaatgtggatcgcatctaatgtttcaagtggaatcaatttatttttctatcactaattaaaaggacgattatgttatttgctttacctgcgctgaatgataactacatttggctttatcaacgagaaaatctgccgcttattattgtggatttgcctgaaacggacaagctgtttgcatggctagagaagcaaaacgcaacgattgaagcggtgttgcttactcacgaacatgatgatcatacacaaggtgtgtcggcatttaaaaaacgttatccaacagtgccgatttatgggccgcaagaatgtgagaaaaaaggtgcgactcaaattgtgaacgaagggaagawccttaccgcaaattatcaaattgatgtcattccgacggggggacacactaaacagcacgttagttttttagtggataatcatttattttgtggtgatgcgttattttctgctggttgcggacgtgttttcacaggtaattatgcgctgatgtttgaaggtttacagcgtttgaatacattgcctgacgagacgattgtttgcccagctcatgaatataccttggggaatttagcatttgcggaaactgtgctggtggataaaagtgcggtagaaaaaagtgcggtagaaaaacaacgtatttttgttgaaacacaacgggctgaaaataaaccgagtttgccaacaaccttaaaactagagcgagaaattaatccgtttttacaagcaaaaacacttgaagaatttaccgcacttcgtaaagccaaagatattttctaagttatctttttattgggggggagcacaaagtgcggtgattttttaaattagcagattatttctttctcgctaacatggtggcaaatttcattttaatgcgattgccgttttcatcggttttgtgtaattcgcccatattttcgttatattctaagaattcccaatctttgtaatattctttcaattcgttttcagcaaaagtgaaagagaatggaagtgggcaaggcacatcatctgtggacatggcggcaacgattaagttatacccgccaacattggtatgttctttcatatttttaatgattgatggcacacgttcacgatttaagaacataaataccaccgttgaaacaataaaatcatagttttcttgaatgttggcggcgttaatgtcgtaaagtgcggtagaaatattaagattttctttctctttagtttcatttaaaaaggcaatgctgttttcattgtgatcccaagaggtcacatcatagcctaataaacttaaataaagtgaattacgcccttgtccgcaacctaaatctaatactttacaaggcgagataatttttgcagcatccaccacatcgccgtgaatggcagtcgtgttgtattttttactgaaataatcttcttttttgcaatagaaacctagggtacattctaggtcatcagaaagtgcttctacacgatgccatgcttgaggttcaacaaaaggaatgtggctttctggggtaaaaatatgctcggcaataacatcgccattttcggttagctcataaaatttaagcttaccttttaatacagttaattttccccaagtgccgacttttgtattgtgcttttcttggaacatttgtggcaagttgtcttttgtccacactggcatttgtttatagcaaattaattcgtttttcatagtattctccaaatagataaatagttgagtgttatggtaggttataagtcatctattttcaacaagaaaataaaaaggcaacgtaatgttgccctcatttagattgaattgattattttacttgcatgcccgcagtgacaccgctatcagcagaaagtaagaataagtcactaccgcctgttcctgcggatagaatcattccctcagacacgccgaatttcattttacgtggtgcaaggtttgccaccataatcacaaaacgaccttctaattcttcaggtttattgtaagccgctttaatgccagagaagacttggcgagtatgatcaccaagatctaattcaaaacgtaaaagtttattggattctggcaccgcttcgcatttcaatacttttgctacacgcatatcaagtttagcgaaatcatcaatcgtgatggtttcagcaataggttcaacggcagaaagtgcggttggttttgcttcagttttttctgcggctttattggctgctgcaaataaggctttagtttcttccacaacggcatcaatttgttttttctctaaacgagagaataaggctttaaacggtgcaagggtatgaccaagtaatggttgatgaatattatcccaacgtaattcagcttgtaagaaggtttctgcacgttctgctagttttggaagaacaggttttaagtaagacatcaatacgcggaaaagctcaatacccattgaacatacggcttgcaattctgcctctttgccttcttcttttgcaatcacccaaggggctttttcatcaatgtatttattggctttatctgttaatgccataatctcacgaatggttttattgtattcacggctttcgtaataagcagcgatttgctcggcttgggcggtaaattctgcaaataatgatttgtcttccagtttatccgcaagtttgccttcaaagcgtttcgcaataaagcccgcattgcgtgaagctaaattcactaatttgtttacaatatccgtattgacacgttgtacgaaatcttcaaggttaaagtctaaatcttcaatgcgatcatttaattttgctgcatagtaataacgcaaacattcaggatcgatatgattcaaataagtgctggcttgaatgaatgtnccgcgagattttgacatcttcgccccatccacagtgacatagccatgagcgaacacattagtcggtttacggtagccactgccttcaagcattgcaggccagaataggctgtggaaataaacgatgtctttaccgatgaaatgataaagctctgcatcactgccttcagcccaaaattcattgaaatcaatgccttcacgattgcatagatttttgaatgaagccatgtagccgattggcgcatctaaccaaacatagaagaatttatcttttgcgccgggaatttcaaaaccgaaataaggtgcatcacgtgaaatatcccattgttgtaaatcgctctcaaaccattcttgcattttgttggcaatttcagattgaagtgagccagaacgagtccattcttttaacatcccttcaaatgcaggcaagtcaaagnaaaagtgttcagattcttttacgataggtgttgtgccagaaacagctgaacgaggattaattaaatccattgggctataagtagaagcacacacttcgcagttatcgccatattgatcttctgctttgcatttcgggcaagtgcctttcacaaaacgatcaggcaagaacatatttttttcagggtcgaataactgagaaataactttactcttaataaaaccattggctttgagtttattgtaaatttctgcggtgagctgtttgttttcttcgctgtgagtggaatgatagttatcaaaactaatattaaaacctgcaaaatcacgaatgtgatcggcttttgctttggcaattaattcttcaggtgtaatgccaagtttatcagcattcaacataatcggcgtgccgtgcgcatcgtccgcacagacaaaatggattttattgccacgcatacgttgaaaacgcacccaaatatccgcttggatatgttctaacatatggcctaaatgaattgccccattggcataaggcaaggcgcaagtgactaaaattttacggggttgagttgtcatttattattctcttttttagcatacaaaaattgtgcttatcttactttaaataggggattttttctagtttgaaaaactttaacttaacataccgcactttccgtgattaaatatgcccgacaaatttactctactaaacaggaagttattatggcaacctacttttctgataatttgactgccgaccagcaaaaccaagttcagcagattattcaacaatttcagcatccaaccctgcaaaaggatctgattgtgcttaatactttgaaaaaagtggaaaagggcggcgatactttacgcattgaattgcaattaccttttgcatggaattctggtgcagaacagttaaaacaagcggtttcagatgcgttgttgaaagcaacagattgtaaattaattaaatgggcggtggcttatcaaatcgccacacttaaacgtgcaaacaatcaaccggcagtaaaaggtgtgaaaaacattattgctgtgagttctggtaaaggcggcgtagggaaatcatcggtttctgttaatctagctttagcattacaagcacaaggcgcacgtgttggaattttagatgcggatatttatggcccttctattcctcatatgttaggcgcagcggatcaacgcccgacttcgccagataatcaacacatcaccccaattaaagcacatggtttatctgcaaattccattggctttttaatgaatgaagatagcgcaacaatttggcgtggcccaatggcgagcagtgcattaagccaattattaaatgaaaccctatgggatagtttagattatcttgttatcgatatgcctccgggcactggcgatattcaacttaccttatcacaacaaatccctgtgactggtgcagtggttgtgacaactccacaagatattgctttgcttgacgcagtgaaaggtatttcaatgtttgagcgagtatccgtaccagtgttaggcattgtggaaaatatgtcgatgcatatttgtagcgagtgcggtcatcacgaagcgatttttggcacaggcggtgcagagaaaatggcggaaaaatacaatgtgaaagtattagctcaacttcctctgcatattcgtatccgtgaagatttagatgcaggcaacccgaccgttgtgcgagtgcctgaaaatgaaatttcacaagcgttcttacaacttgccgaaaaagtctctacagaactttactggcaaggttccgtaatcccaagcgagattttatttaaagaagtgaaataatcaaaaaagatagggctgcatgtgcagcccttttttaatgggatttttaccccacccatttcaccacttcatccaatcctttacgggattttttcgcaatatcgcgtgagcgatagccaaaggttgcggcgacagaaaccgcatattcttgaggatcgaataatccttcttcggcgaggcattcattcattttgtcgtaatgaaaaccttcaattgggcaagagtcgatgccaagggctgaagctccagtaagcatatttgcaagggcgatataagtttgtttgctgcaccaatcaaataaagtgcggtcgttttcgagtaatttcatatcttcttcttgcagggctttgtattttgtgagggcggcttgttgttgctctgcgttcaagcctttgcgtgccatcacatccacaaaaaacggactatcataacgggcatttttcttcgcgagaattaccacaagatgactgcaattatcaagctgatttatcattccccagctaaaaggtttcattttttcgcgtaaggttttattttgaatcactaaaaatttccaaggctcagagcctacagaactcggcgataatcgaccgcactctaaaatacattcaaaatcttcatcactgattttttttgttgggtcgtaataacgtgttgagctgcgttgatggaagagttcaagaacttgttcacgagtaagttgagtcattttatttcctctttgttaaacaaaaatgtggtgccatattaaagattagtttttgctaaaacaagggaaagattctagaatagtcagcgcttttatcacagagggtgaaaataataatgacaagaattgcaattattcctgcgagagcgggttctaaaggcattaaagataaaaatttacagcttgtggggggcgtttctttggtggggcgagcgattttggcagcgcaagaatcgggtatgtttgatcaaattgtggtgacatcagatggcgaaaatattttaaaagaagccacaaaatacggcgcaaaaccagtggcacgccctgaaagtttggcacaaagtgatacacgcaccattgatgctattttgcattgcttagaaacacttaatatttcacaaggcaccgccgcacttttgcaaccaaccagcccattgcgtaatgctttagatattcgtaatgcaatggaaattttccttggcggcaaatataaatccgtggtttcagcttgcgaatgtgagcatcatccttataaatcctttactttagaaggcactgaagttcagcctattcacgaattaacggattttgaatcccctcgtcaaaaattaccgaaatcttatcgtgcaaatggtgcaatttatattaatgacatccaaagtctctttgaagaaaaacgtttttttattgcgccaatgcgtttttatttaatgccaacttatcgttccattgatattgactccacacttgatttgcaattagccgaaagtttaatttcaaaagaattctaaaaaaattggccgcacttttgatctgcactccaaaagttggattaaacaaccaactaaggtgcagattttttatgaccaaatacaatttttttcaagcaacaagtcatcgagttttatcttcaaaatagtaaaaattgttgattcctctgcaggcattttcaacttgccagcagaacattgtgacattggattaatcaatttgatcatattagaatcaatggcttagcgttgctgggtaagaagtgaaattactcatctgaatttaaacttaggatgatacaatcggttaaaagtaagcaattttctgcagaacccgcttgcttacattttggcactggaaatggctagggattaagaataccgagttcaagtgtgtgaaaggcaagctctatttatccccaattaaggatttatttaacaatgaaattattgcttatgatttagtgcgaagcccgaattctgagcaaattacccaaatgatgaaacaagctgtagcaaggcttgcaggcgcaaaaccgattttacattccgaccaaggttggcagtatcagatgataggttatcaaaacatacttagggagaatggcatttaacaaagtatgtcaaggaagggaaatgatttagataacagtgcgatggaaagcttctttggatgattaaaaacggaatgttattacggcaaacgatttgagatgttcaaacaactggaaaaaacaattcatgagtacattcattattacaaccatgagcacattcaggggaaaccaaaatggctgagtcctgtgaatgacatagctcaacccttgaactaaataagtctaattttttagaaggtcaattccagtaaaatcaaggctttgtaatgtcttatagtgatgtatgattttggtttttggtggagctggggggagttgaacccccgtccgaaattactctaccttcagtactacacgtttagtctcgtctttaatttcacttaagcatgcggacagacacgctaaacttaagctagtttgattcaatttagtgcttcgatcctcaaacggtggcttccacacgatctcgttttggtttgactccgcgttatccccgtcttacgagcggaagctggagcgcgaaggctaaatgcaggttattaagctgctaaagcgtattgttcgtcgtttgcgactatttttttgcggtttatttacgaggcctaccgcacctcgacgtgcaccttgggcttcgctaatcccgtcgaatccagaatcagccccaaaattgcgtgttagtctagcaaaaaaagaaaggtagggaaagtcgagattgattgaatttttgtatgaaagctagaataaccttaaatattgtctatttattattggcttattaccttattaacaattcatctctaaattgattggagacgatcattgattttttatggacgggaggcttgataatggcgttaattaattggcattatttcacgctttatttttgatgataggagctatagatttgtaaattatggcaaaattaaatatatttacgaattcctgaaaatataacacagcatatatgctataattagctcctaaactttttggaaaatgttatcttattctagtatttatcatcaatgattttataaaatttcttgcatattaaatttttatcactataatgtggcacatatttcggacgcggggtggagcagcttggtagctcgtcgggctcataacccgaaggtcgttggttcaaatccagcccccgcaaccaataataagttcagtaaaagaaccccagttttggggtttttttctataagaaatttagtaactgggcttaggttcttatgaacctaaccctttttttatgcctgagatttaataaactatctttttactattactaaaatagagggataagtattgtttaggataaggtttcataaggttatgatatagtgcggtgaattacaccctatataggagtagaaattggctacattagaacaaaatttacaagaaatgctacaagatgcggtagaggatttaggctgtgaattgtggggaattgagtgccagcgcgtgggtcgttttatgacagttcgtttatttatagataaagatggtggtgtgacagttgatgattgtgctgatgtaagtcgtcaagtgagtgcaattttagacgtggaagatccaattgcggataaatataatctagaagtgtcgtcacctggtttagatcgtccgctatttaccttgccgcaatttgaacgctatattgggcaagatatcgcagtgcatttgcgaattccagtgatggaacgccgtaaatggcaaggtaagttagagcgtattgaaaaggatatgattactttaattgttgatgatcaagaacaaattttagtcttcggaaacattcaaaaagcgaatgttgttgcaaaattttaaaaggagaaaaagagaaatgagtaaagaaattttactggcggcggaagctgtatccaatgaaaaattattaccacgtgagaaaatttttgaagcattagagagtgcgattgcgatttctactaagaagaagtttgaatatgaaacggatattcgcgtttcaattaatcccaaaacaggagaatttgatacttttcgccgttggttagtcgtagatgaagtaaaagtaccaacgaaggaaattactttggaagcggcgcaatttgatgatccaaatttgcaacttggagagtatgtagaagatcaaattgaatctattgcatttgaccgtattgcaatgcaaacggcacgtcaagttattagcactaaaattcgtgaagccgaacgtgcaaaagtggttgaacaatttcgtgaagaagaaggaaaaattgtaacaggcactgtaaaaaaagtaagtcgagacagtattattttagatcttggcaataaagcggaagcgatgattgcgcgtgaagatatgttaccacgtgaaaacttccgtccgggagatcgtgttcgtggggtactttataaagtaaatcctgaaggcaaaactgcacaattatttgtgacacgttctaaaccagaaatgttgatcgaattattccgtattgaagtgcctgaaattggcgaagaaatgattgaaattcgtggtgcagctcgtgatgctggctctcgcgctaaaattgcagtgaaatcaaatgataagcgaattgatcctgttggtgcttgtgtaggaatgcgtggtgcgcgtgttcaggtaattacgaatgaacttggtggcgagcgtgtagatatcgtgctttgggatgacaatcccgcgcaatttgtgattaatgcgatggcaccagcggatgtttcttctattatcgttgatgaagataatcattctatggatattgctgttgaagctgataatcttgctcaagccattggtcgtaatggtcaaaacgtgcgtttagcaacacaattaacgggttggacactaaacgtaatgacgactgatgagttaaatgctaagcatcaagcagaagataacaaagtgttaaatttatttattaacgcattagaacttgatgaagaatttgctcaaatccttgtggaagaaggcttcacaagtttagaagaaattgcttatgtgccaatgaatgaattgacagcaattgatggtttggaagatgaagatcttgttgaagagcttcaaactcgtgctaaaaatgcgattacagccgcagcagtagctgaagaagaagcactgaaaaaagcgaatgttgaagatcgtttattgaatttagagggaatgaatcgtcacgttgcaatcaaactagcagaaaaacaaattaccacccttgaagaactcgcagaacaaggcgttgatgatttaactgatattgaagaattaaccgcagaacaggccgcagatttaattatggctgcacgtaatatttgttggtttggcgaagaataaggagagcagtaatgactgaagatgttaaggctgatgcgccaaaaaaattaagcattcagcgcagaacaaaaacaacagtgagcagcaccacaactggcggtaaaagcaaagaagtacaagtagaagtacgtaaaaaacgcacagtaaaaactgatattgctcaacaagaagaagcaaaattaaaagcacagcaagaagcggaagcgaaaaaaattgctgaacaaaaagcagcagaagaaaaagctcgtttagaagctgaaaaagcaaaagctgaaactgctaagccagtaaaaagtgcggtagattctaaagctaaatctgttgagtctgaaaaagagaaacgtaaagcaggagaagcagaacttcgtcgtaaagctgaagaattagctcgtcaaaaagcagaagaacaagctcgtcgtgcagtagragaagcgaaacgttatgctgaagcagatgattcagacaatgaatcttcttcagaagactattctgattacaatctaagttcaagatatgcacttgaagcagaagatgaagaagatcgtcgtaatgaaaatcgtggtcgtggcaaaaataaagtagcgaaagcgaaaaaaggcggtcgcgacgatgaaaatagcaaaaactcgaaaaacgagcgcgaatctaatcgtaaaaatcaaaaagacgctaagtttggtaaaggtaaaaatggcaaaaaaggtgccgcacttcaacaagcctttactaaacctgctcaagtagttaaatcggatgtagtcattggagaaaccattacggttgcagaacttgcgaataagatggcggtaaaagctacagagatcatcaaaatgatgatgaagatgggcgaaatggttactatcaaccaagttatcgaccaagaaaccgctcaattagtagcagaagaacttggtcataaagtgattcttcgtaatgaaaatgagcttgaagaagcggtattaggcgatcgtgatgtaaacgcagaaaaagtaacccgtgcgccagttgtaaccatcatgggtcacgttgatcatggtaaaacctctttacttgactatattcgtaaagcgaaagttgctgcaggcgaagcgggtggtattactcaacatatcggtgcgtatcacgtagaaatggatgatggcaaaatgatcaccttcttggatactccaggacacgcagcgtttacttctatgcgtgcacgtggtgcaaaagcaacagatatcgttgttcttgttgttgcggccgatgatggtgtgatgcctcaaactatcgaagcgattcaacacgcaaaagcagcgggtgcacctttagtggttgcagtaaataaaatcgataaaccagaagcaaatctagatcgtgttgagcaagaattattacaacatgatgtcatttctgagaaattcggtggtgatgtgcaattcgttccagtatcggcgaagaaaggtacaggggttgatgatttattagatgcaatcttacttcaatctgaagtgcttgaattgaccgctgtaaaagacggcatggcaagtggtgtagtcattgaatcttacttggataaaggtcgtggccctgtggcaactatcttggttcaatcaggtacactacgtaaaggtgacatcgtactttgtggttttgaatatggccgtgtgcgcgcaatgcgtgatgaaaacgggaaagaagtggatgaagcaggtccttcaattccagttgaattattaggtctttcaggcgtgcctgcagcgggtgatgaagcaactgttgtgcgtgatgagaaaaaagcacgtgaagtggcgttatatcgtcaaggtaaattccgtgaagtgaaattagctcgtcagcaaaaagcgaaacttgaaaatatgtttagcaatatgtctgaaggcgatgtggctgaattgaacgttattgtgaaagcggatgtacaaggctctgtagaggcgattgttcaagcgttaaatgaactttctaccaatgaagtaaaagttaaagttgttggttcaggtgtaggtggtattactgaaactgatgcaactttagctaccgcatctaatgccatcattgttggctttaatgttcgagcggatgcaacagctcgtcgtgtcattgaagctgaaaacattgatttacgctactactcaattatttatgaattgttgaatgaaattaaagcagcaatgagcggtatgttagagcctgaatttaaacaagaaattattggcttagctgaagttcgtgatgtattccgtcatccgaaatttggtgcaatcgcaggctgtatggtaactgagggtgtagtgaaacgtaacaacccaatccgtgtattacgtgacaacgtcgttatatttgaaggggaattagaatctcttcgccgtttcaaagacgacgtatctgaagttcgtaacggtatggaatgtggtatcggcgtgaaaaactacaatgatgtaaaagtcggcgaccaaattgaggtatttgaagtggttgaagttaaacgttcaatctaacttttaacaaaataaagggcggttaaaaatcatagtgtttttaatcgcccttttgttattaaataaaccgcatcaaaattataaaccagttaaatcctcagcaatttcttcagcttgtttaatcacataagttaccgcttcttcctgtttatcaggcgggtatttatatttttgtaaggcacgtcgaacgagtaatctaattcttgcccgcaccgcttctttgtactgccagtcgattgtgaccgattttctaagtgtttccgtgatttctttcgccagtttagaaagcacttcatcacccatcaaatcttttgcactttgattttgagatagagcttcatagaaggctagttcttccttggttaatcctagttttttccctaatgctaaacgttcttggaaatcttggctcattttaaagagttcgtccaaaatctctaccacagtcaaattgtgattgtggtattgattcaatgcttccttcaaacgccgttcaaaatctttttgcaaggttaagtttgtgcctgatttaactttaatttcacttgccaaataacgctccatcgcgctaacccataaatttttagttgggctattttttacagtttgtaaaaattcctcggaaagcaaactgatttgtggttgtggtttttctagcagatcgaataaatcaatcacgccttcagaatacacagtttgattgaccaattttttcaataaaatctgtctttcatttgtgcctgtgcctttttgttcacgtttagttaaaattgcccgtacggcatcataaaaggcgatttcttggttatacggctcaacttcagccaatgtgccgcacagcatatagcctttttttaccaagcctgccgttttcaaaaaggcttttttgcgtggctcggtttcttttttattaaaccaatgctgctcgtgcgctttgccatcaaacgataattgatcaaggcttaaaatatggttggcggcaaaacgaatcgccatcaaaagatcattcggattatctttttctaaggcagcctgaacatcaaaagtttttccttcaattggtgtcgcaaacaaagttcggataaattcaagctgttctttcattttaaagaacacgctttgcacatcttccgctaattgacctttgcctgtagagttggtgtattgctgtgtggctgctcgtaattcttttgccaaaccaacataatctacgataagcccaccgttttcacgacttttgttagcgaatacacggtttactcgtgcgatggcttgcattaggttatgccctttcattggcttatcaagatacatagtgttacagcacggtgcatcaaagcctgtcagccacatatcacgcacaatcaccactttcagcggatcgttcgggtctttaaagcgacgttctaacgtttgcttttcctgcttactgtaaatatgcttttgcatttcaggcgtatcgcttgccgaacctgtcatcacaattttaatcgccccttcgttaatattgtccgaatgccattcagggtgcagagcgatgatctgattatacaaatccacgcaaatttgacggctggaaaccaccatcatcgctttgctgtccaccacttcattgcgtttggcaaaatgttgcacaaaatctgcggccaattcgataagacgctcttgtgagcctagtaatttttcccgcaaacgcagggaagttgatggctcctcttctagtagagcatcaatttctgcaaacaaagcatcgtggtcttttttatttaagcgaatttggcgagcatcatcataaacaatcggtacagtcgctccatcttccaccgcatcttgcaagtcataaatggacacataacgaccgaacacatcttgcgtgtccttatcttcaaggctaattggcgtacctgtaaaaccaataaacgaggcattaggtaaagcatcacgcaaatggcgagcataacctgtctgaaacttgccgttatgcagcttttgcgtaaagccatattggctgcggtgagcctcatcgctgatcacaataatattgttgcgctcatttaaaatagggaagcggctttcttcctcatttagggcgaatttctgaatcgtagtaaaaaacacgccgccgacttcattttgtgcgagcagttggcgcagttgatcgcggtcttctacttgctgcggtgtttgtttgattaaatccttgcctgaagaaaaagtttggaaaagctgaccgtctaaatcgttgcggtcggtaaccactacaatggtaggatttttcaattcaggctgtgcaagcagtttgcctgcataaaacagcatcgaaatcgacttgcccgaaccctgcgtatgccacatcaccccaatgcggcggtcgcctttttctgaagtcgcccaaatggtggaatctaccgcttcatttacgccgtaatattgatggtacgccgcgatttttttaatggttttgccaacggaatcccgttcaaacaagacgaaatagcggatatagtccaataaatcctcaggctgcattaagccattgagcaggctttgcaactcatcgtcaaaatataagcgcgcgcttttatttttttcatcgaccactttccacggcgtaaagcgttggaaatctgccgaaagcgaacccaaacgggcgacaatgccgtctgaaataatcagagcttggttgtaaacaaacagctcggcaatttcatctttataggtttcaaattgattaaacgcctgcaacaaatccgccgattcacgcaacggatttttgagctcaaataccaccaacggcagaccatttacaaagccgataatatcgggaatccgtttacctcctttgcggctgcggatttccaattgattgacggcaacaaagcggttgtttccccaatgctcgaaatccaccaaacgcaccatctcaattttctgttcgccgttttgcgtatattcgacccgcacgccatcacgcagcagtttataaaacgtctgattacgcacaaccaagtcgccaatatcgcttttcgttgccgatttcactacagaatccaccgcactttcaggaagctgaggattaagtttacgcaccgcctcacgcagttgctcaacaaagactacgccgctcaaatcgccacgggcaaacttgccctcatgaacaggcaagtctttaccgtagcgatattcccaaccgagggattgcaggcgttgaagggtaagttgttcgatgtcattttcgttgagcataggtgttccttttgtgtatttgctgtctttggggagctaatagattaatttcttcgtttattggcagaagtgaaatcaatctcgtgagtaattaaatttccccattcaacaatctaggcagcaataaatctcttatttcagttagtctcttattttcaatagaatttgataaggtcttttcaaaaatagaaacaacttttttttgaaaaatatagataatttcttttgatggtgtaattatctctattttagagaatgtgcttgtgtttaaatttaaagttgcagtgccaccacttgccaaatcttttagatattttgtcattgatggctgttttaacgataaatataaaaactcacaggattgttcatcatctggaataattgaattaatttgttggtttgtatgagatggcttagatgtcattgaaaccaatccgacagtagcaatacaacttacacaaatgctttttgctggaatatattttttagattggtaatttgcacctactacactcaagttatctgttgtttgagtaataaatacttgattgtgcatatctggaatcttaataaatggcacatcatcaccataaaattctttgttggattttgatggtgttttcccgcagataatttgacctaaatctgataaggctttcatttcccaccccctcggcacctcaaccccatcaacctccaccccatcaacctccaccatctcacacggaaacgctttggcggtttcggctaattcggcgtagcggtcaggctgtgtttgtgaaagtgcggtcagttcttcgggtgtttttccgctgattgcctgcatggcggcaagttccgcttgttcaaggctcatgccgtccgaaagggcttgggctttggcacgcacgggatcgaaatcgacaaaccagcttttaaacagcgcttgggcgatttgttccaaggtttggttgatttgggtgttgagttctattttgtcatctaatggggtaataatatcaaggattttttgttgtgtttctttatctggtatatttaaagataaacttgaaaccgaatcaaatgtgatctgtggaaatgttccagatcttgattcagctatcattttaaaatattcggttgtttcattgctaattagtagtaaaaataggaattctggtaatacaatattagcattaggctcaattaccataaattttgtggaaacaacataattgtctaaatcattatctacaaataaatatcgtccattacctggtcttatttcactatatagaatatcgcctttttttatggctttcttagcttgccctggtaaatctttgacgtttgatatctcgcaatgtagaaatttattatttaatacatccccagtgttaataaatacaacatttgggtatgcattaaagtcaaaccttcttgatatatttcttgatatatcacccagagaatactctttccaatcactcataacccaatccccctaaattcttcttaatctcagcttccaattccgcactttttgcaaattgctccttcaaaagagcggtcagattttgcattttttctgcaaatggcacgccgtcgtcttcttgttctgcagtgccgacgtagcgccctggtgtgaggacgaagtcgttatttttaatctcttctaaagtcgcggatttgcagaaagcggcttggtcttcgtagccgtctgatgtttgccaagcgtggagggtatcggcaattttggcgatgtcgtcagcggtgaaatcacgcaatacgcggtctttcatatagccgatttggcgggcatcgataaataatacttcgcctttgcgctttttgttgcggtttaaaaaccaaatgcaggcggggattttggtgttggtaaagagctggccgggcagggcaaccatacattcgaccaggtcggcattgatgatggctttgcggatttcgccttcgttgttggtttggctgctcatagagccgttggcaagcaataatgctattttaccgtttggcgagaggtggtaaatcatgtgttgcagccaagcgaagttggcgttgcctttgggcggtgtgccgtatgcccaacgtggatcatcggcaagggattcattccaccattctttatcattaaaatgcggattcgccataataaaatccatctttttgtcgatgtgttgtggctgggtgaaactgtcggcgttgtatttgccgaagtcgtaatcaatgccgcgaatygccatattcatggcggcgagtttccaagtggtcgggttgaattcttgcccgtagatggaaacgttgttgatgttgccttgatgggcggtgataaagcgttcggtttgcacgaaaaagccgccactgcccatggctgggtcatacacgcgtcctgaatagggttcgagcatttcgacaatcagggaaacaatggatttcggtgtaaaatattgccactgcgtttssttcggcttgagcaaatctgctgaggaaatattcgtaaacgtggccgagaatatcttttgcgcctaaatgtacgggctcgccgttgtaagttgggcgggtaaagtgggtatcggagaagaggataatcagcccgcgcagggtgtcttcgtttacggcatagccgctgatgcgttggagtacgcctttgagtttttcgttgtctttttcaatggcatcgaaggcatcgtcaatcagttttgccacaccagaaaattttccaccccaaggcaattctgccccagtgttgagaatagagacttcttgtaaggcttgccaacgtgcagaagctggcacccaaaatacgttatcagcggtgtaataatcacggttttctagttctgcggttaaggcttcttgatattcttcttcagtatcaaaaaaagtgcggtcaagatagaggggattttcaggtgtggagagttccgcctgaattttttcctgttgatgggtgaaactatcggaaatgtattttaagaagataagaccaagaacgatatgtttatagttagcggcatcaagttgtttgcggagtttatcagcagatgcccaaagtttttcgtctaawtcatttaaaaatgcttgttgtaatgtgtgatttttatcgacaatcttggtcgtctcgtctcgtctcgtctcgcttgcataaattatgccctctgtaaagtgatttttatcggaagtttgaatattcaaacaaattatcaggtgtcattttatcgaaaaacagtattaagttgaaagggatttttgcgtgctaaattcaatgatttccagtagaatgaggcgcttttataaataaggaataactatggcaagagaatttaaacgtagcgaycgcgtcgctcaagaaatacaaaaagaaatagcagtcattttacaacgcgaagtgaaagatccccgtattgggatggtgacggtttctgatgtggaagtgtcaagtgatttatcttacgcaaaaatctttgtgacttttttattcgatcacgatgaaatggcaattgagcaaggcatgaaaggcttagaaaaagcatcgccttatattcgttcattactaggcaaagcgatgcgtttacgtatcgtgccagagattcgctttatttacgatcaatccttagtggaagggatgcgtatgtcaaatcttgtgacaaatgttgtgcgtgaagatgagaaaaaacacgttgaggaaagcaactaatgtctagacctcgtaaacgctggcgtgatgttgatggtgtgtttttgttggataaaccacaaggcatgtcatcaaatgacattatgcaaaaggtaaagcgtttatttcaagcgaacaaagccgggcatactggcgcgctcgatccgttggctacgggaatgttgccgatttgcttgggggragcaactaagttttcacaatttttgcttgatgccgataagcgttatcttgttacggcaaaattaggcgaacgtaccgatacttccgatgcagaagggcaagtcgtggaaactcgtgaagttaatcttgaaactcagcaaattttgaccgcacttgaacaatttcgtggcgatattttgcaagtnccgacaatgttttccgcactaaaacataacggcaaaccgctttatgaatatgcgcgccaaggtattaccgttgagcgtgaggcacgtccaattacgatttttgaacttaattttattgaatataatgcgccttttttaaccttagaagtgcattgttcaaaaggcacttatattcgcaccttagtagatgatttaggtgaagtgctaggttgtggcgcgcatgtnacaatgttacgccgtacagccgtagcggattaccccgtagcagaaatgatgccaatcaatgagttacaactgctcgctgaaagttttccattaagtgaattagatcgtctattactgccaaccgataccgcagtaagtaaattgcccgctttgcatttggatgcagagcagagtaaagccattggttttggtcagcgagtgaaatttgctaacgaacagcaattaagtggtcaagtgcggttattttcagcggagaatttattcttaggcgtacttaatcgacgggaatattattcgcccacaacgattaattacacaatccgcataacttcattgcctttcctgtaaaattctagtaatctccttgtaattaattttttacaatatatgtaagataaaaattacaggtgagttttatggaagcccttaaagatttacgttctgaaattgattcgcttgatcgcgaacttatccaactttttgctaaacgtcttgagttggtttctcaagtcggtaaagtgaaacatcaacatggattacctatttatgcgccagaacgtgaaatagcaatgctccaagcacgtcgtttagaagctgaaaaagcaggcatttcagccgatttaattgaagatgttctacgccgttttatgcgtgaatcctatgccaatgaaaaccaatttggttttaaaactatcaattctgatattcacaaaattgttattgtgggcggttatggtaaattaggcggcttatttgcccgttatttacgtgcatctggctatccaatttctattttagatcgcgaagattgggcggtggctgaaagtattttagcgaatgctgatgtcgtgatcgtttccgtccctattaatctcaccttagaaacaattgaacgcttaaaaccttatttaacggaaaacatgctacttgcagatttaacctctgttaagcgtgaaccgctagcgaaaatgcttgaagttcatactggtgctgttttaggtttacatccaatgtttggtgcagatattgcaagtatggcaaaacaagtggttgtgcgttgtgatggacgttttcctgaacgttatgaatggttacttgagcaaattcaaatttggggtgcaaaaatttatcaaaccaatgccacagaacacgatcataatatgacttatatacaagccttgcgccatttttcgacttttgcgaatggtttacacctttccaaacagcccattaatctcgctaatttattggcactttcttcccctatttatcggttagracttgcgatgataggtcgtttatttgcgcaagatgcagagctttacgcagatattattatggataagtcagaaaatttagcggtaattgaaacgctaaaacaaacttacgacgaagccttaactttctttgaaaataatgatcgtcaaggttttattgatgctttccacaaggtgcgtgactggtttggcgattattccgaacaatttttaaaagaaagccgtcagctattgcaacaggcaaatgatttgaaacaagggtagagaaaagtgcggtgaaatttcaccgcagttttttactgtctcgctaatcttaaattttcaggtaaattctcaaaattagagcggaatggattaatgtctaatccgccacgacgggtatagcgtgcgtaaacggtgagtttttctggttttgcgtagtgcattaaatcgcaaaaaatacgttcgacacattgttcgtggaattcattatgttggcggaacgatacaacgtaacgcaataatttttcctgattgatttttttaccaacatagtgaatatgcaaggtgccccagtctggttgattggtaatgaggcagttagatttcaataaatggctgactaatttttcttcgacaatttcatccgatacgcaatctttcagccaattagcgttaaattcgtagctagtaatttcaatatcttgttcatcaatgcaatcgccttgtaaatgatcaattttttgagaatcataaactgccattggatttaaccgcacttttacatcgccttgcgcacattcgcttaaatcacgttgcatagtttgttgaacggcgttgaagtcggcaaatttgctttggttaaagctatttaaataaagtttaaaactttttgattcaatcaaattttggctttgataatccagataaatatctgcgatagccacttgcggtaagcctttttcgttgagccacgagatttcataagccgtccaaatatcggcgccgatagtaaatggttggttttgagtaattcccaatccatcacgatttaacgcgcgtggcactggctgtaataaagtgcggtcatattgagaggcatattccgttttttgaccgagttttaaggattttaagctgttgtcttggtaattcatttatttttcctttatatgttaaaaaataattttgccttcccttgcttgcgggggaaggtggcgcgaagcgtcggaagggggctaagactttatcattccaacagagagttgaggcatcgacttaaattacaaaaaattccacgatagattcgaaactaatcgacaggtatcgcatttaaaatgaaaggtatcaaaaatcgcgtcttttaacgcccaatttgcaccacaagaagggcagcaacgggatttttcagattttaaagattgcccacctacacgatataaataatagtaagtcggtatgccagtttctttttctatttcttgggctaaatatcgtccgtgttttgaaagcgtactttgatgatcggaaatttctgccaaagattgttgttctaatactgcaccattcatttgtagttgatcgcaggcttgccaattttcttgccatttaatcagatcttgggttaagtgcggttgattttttagttgtttatacaaagggatgggtgcgaaattttctccactatgaatcggcgagcaactttgtaaatgggttgtgtaaagcacttgccaagctggcgacgcattttctgctgtttgatctgaattgaaatcatcacccacaagttgaaaaccatcaaaaattacaccgcacttttcggcttcttgtaatgcccgattcacttctgcgttattattttgtgggaaaagactatcttgctcagggcaaatgacacgcatagcaaaaccttgtgcgccatcttcttccgctaaatataaaggaatttcacgtccgataatttgcccgttataccgccattgatcgatcactgcattgagtaaacgactttgtgattcaatattattttcgagcgcagtcaggcgaaaataggtttcgattaaatacataaattttttaattgctgtccgatttggtttaagccgtttaaacgcatttcacttaaacgttgtgaaatgccgagttcgctaaaaaatacagtaatatcaaatgtattcaattcatccgctgttttgccattgatttgattgaataaaatccaaagtaagccattcataattctggcttcgctaaatccgctgaattgaaaagtgcggtcatttttaggcataatttgaaaccacatttgtgcttcgagccagtaataggttgcatttgagcgagttcattatcgcttgggcgaggtaaatttttgcctgcttgaataatcaggcgatagcgatcttcccaatttttagcttgttttaattgttctatcattgtaataaatccagtgctttatctaaggcggtgaagaatgcctctacatcttcttgtgtattataaggggcaaaagacaggcgtaatgtggtgcgttcgcctaagcgtgctaaataaggctgggcacaatgttcgcccacacgaagcgcaatattttgttcgctcaaaagtgtagaaagatcagaacagtcaatgccatcaaatacaaagcaaacaacggtgcttgcttgaggagaattgaataatcggcaattctcgtaagattttaaccgcactttgacggattcagccaaggatatagcgtactgttctgcagcggtaaaatcccatttttgtagccaatccagcaccgcattaaagccaataaccccagcaatattgggtgtgccagcttctaaacgataaggcaattcggcaaaagtaatacgatcatttgatacacgatcaaccatttttccaccgaaaaagagcggttgaagttgagaaagtgcggtcaattttcctgttaaaacgccaagcccatttgggccataaattttatgggcagaaaatgcgaggaaatcggcatctaaatcttgtaaatcaattttgatatgactaatcgcttgtgctgcatccactaaaaccaaggcattgctatgttttctaataagttgaatcaggcgtttaatcggctgttctgtgccagtgacatttgaaacaaaatttagcgcaacgagttttgttttttcagaaagggctgaaatcagcgcattttcatcaattagccaattatctaaaatcggtaaaacttgaatttttgcaccgcactttttcgccgtttcatgccaagtgacaaaattggcatgatgatctgcttggctaatcagaatttcatcttcggcgtttaattgcggcatcaatccatttgccactaagtttattgcgtgagttgtacccgaagtccaaataacagcgtgtttatcttctgcatgaacccattctttaacttgtgtgcgagcctgttcatattgcacagtttgggcagcatcatattggctgcgatgcaccgaacctgcagacgcataaaattcagcggtgcgatcaattaatacttgaggtttcaacgtggtggcggcgttatctaaataaataaccgcatcttcacgttggaaatagggaaatgcttgacgggaacgtttgataatcaaaagccatattaattttctcttgtctgcgccattgacttggttcaattggattattgtctgcccaaagaccaattcctttggcttgtgcattttcttgtgcttgaagataaatcggatcatgggaatattgcttataagcccatgccataccctgtttaaccatttctaaattaatattttgtttttgataataaaccaccgctaaggtgcgttgatagcgatcttttccttttcgcgcaaggcgaacatttttttgataaaccagatcagacaaggtttttttcgatttttgcccaaaggcttgagatttttctggcgcatcaatttcggctaaacgaactttaatggatttattgcctttagtgaggcaagtgagcgtatcgccatcactaattttaaccacacgacacgtatttttttcgcgagaacaagcagaaagtacggtaaaaataagtaataaactcgtcaatagtatttttcgatttatcattttgcaaagtttttgatctaagtctggttattttaccgaaaaaatggctcaagttagcaaaaaaaagcgtaaaataattttgaaatattatgaaaatagttgaaaaggttgtatatgattaaaaaattatttttattagttcgttcgttggtcattttatctattatgttatatctcggaaatcttattgcttattacattccatcaggtgttccaggaagtatttggggattgttattgctctttttaggtttaacaacacgagtgattcatttaaattggatttatttaggcgcaagtttgctaattcgttttatggcggtactttttgtaccagtgagcgtgggaattatcaaatattctgatttattgatagagcaaattaatattttgcttgttcctaatattgtgagtacttgtgtcactttacttgttataggatttttaggtcattatttgtatcagatgcaatcttttacacataaacgcaaaaaagtaataaaacgtagagaaaatcaggtaaaacaagcgaattagtatgttaggaaagtttatatgcagcagtacattatttatctttatacatttttaacaatttttgggttttggctcgcactacaaattagcaaacgttggaagtcaatgatttttaatacttttgttttaacagtattaattttggcggcgattttagtgataggaaagattccttatgatgattatatggcaggaaatgcgcctattaataatttacttggcttgagtatcgttgctctcgcattgcctctttatgaacaacttcgccaaattgccagacaatggaaaattattctttcaacggtggttatagcctcttttttggcgatgttaagtggcgggcttttagcacttcttttaggctcaacgcccgaaatggtcgctacggttttacctaaatccatcacaatgcctattgcgatggaagtttctcgtcatttaggcggcattcctgccgtaactgcagttggtgttgtggttgcaggtttgcaaggatcgatatttggttatcttgtattaaaaaaattgggtgttaaacatcaagaagctattgggctttctgttggttcggtttctcacgcgctcggtacagtaagttgtatggaaacgaatccaacagcgggaagctacagttctatttctcttgtgctttgtgggattattagttctattctcgcgccatttgtatttaagctgatttatttctttgtttaaatatcaataaaaattcaaccgcactttattcattttagattgcgtttgttatagataaagtgcggttgttttttgcgctaaatgattagataatgcagaaaaacgaaataaaacaaagcgatatgaaaccacttatcattgattcttcttggacagaacgttttcttcctgatcctccacgcgaaaaagataatcgtccaccatttcgtcgtgatcgtgggcgaattttacattctgctgcttttcgttgcttacaggcgaaaactcaaattcactcaattggcgaaaatgatttttatcgcactcgcttaacccattctttggaagtggctcagattggcagtagtcttgttgcacagcttaaatttttagaaacctttgaaagcctttcacaaacattaaatattgataaaaacgagttgcaaaaacaattaaaacctttattgccgagtaacgatcttattgagagtttgtgttttgctcatgatattgggcatccaccttttgggcatggtggcgaaacggcattaaattatatgatggcagagcagggcggctttgaaggcaatgcgcaaacctttagaattttaacaaaacttgagccttacactgaaaatgcagggatgaatctaacacgtagaacactattgggtgtcgtgaaatatcccgcattgttagatgtgcttcgcctcaatatgcagaacttaatttttctcgcaatattgatcctcgttttgtgcgtattcacgattggattccaggaaaaggcattttccgtgatgatttaaaaatgtttaattggttgctggaaaatctttctgaaaatgaccgcactttattctgtcaatttaaaaaagtgcgggaaaatccagctgaatctttacatactcggtttaaatcgctggattgcagcattatggaattggcagatgatattgcctatggcgtacatgatttagaagatgccattgtgactggcatggtcaatcctcatcaatggcaagcggcacattccgcattgaaacaaattccatcagcttggttgcatgaaaatattgattcaattagccaacgacttttctctgataaacattttgaacgaaaacaagccattggtgcattggtgaacttttttattactaatgtgcggtggaaattaacggcaaattttgatgaacctttgttacgttataacgcagagttgttacctgaagtgattattgcacttgtgtatttaaaaaatttgtttgggattatgttattcgcaatgtagatactcaacgaatcgaatataaagggcagagaatgctaacagaaatgttccaaatttttgaatctgatccagagcgtttattacctcgaaatactgcaaatcgttggcgtaatgcccctgaagaaaggaagaagcggattatttgcgattatattgcaggtatgtcggatgcacacgcattacgggtatatcaacaactttgatttaagagagaatcccatcgaattgatgggattttttatgcaaaccgtatagaatagtgcggttaattttcactgaatttttatggggcagctgtggcattaattagtttaaccaatggatacctttcctttagtgatgcgcctttgttggatcacgcagaactacatattgaaccgaatgaatgtgtttgtttagttgggcgtaacggcgcaggtaaatcaactttattgaaaatcatcgcaggcgatgtgcttatggatgatggcaaaatccaatacgaaaaagatcttgtggtttctcgtttagaacaagacccaccgcgtaatgcacaaggcaatatttttgattatgtcgcggaaggcgtagggcatttaacggatttattgaaagaatatcatcagatttctgttcaattggaagaaaattacagtgatcaaattttaagtcaattagagcaagttcaggctaaattagaacacgctgatggctggcgatttgaaaataaaatcaatgaagtattgttaaaactaggtttaaatccaaacacaaaattatccgcactttcgggcggttggttacgcaaagcggcactagcacgtgcattggtgtgcgatcctgatgtgttattacttgatgaaccaaccaaccacttggatgtggaagctattgaatggctggaaaatttcttactggatttccaaggtagcattgtatttatttcccatgaccgttcttttattcgcaaaatggcaacacgcattgtggatttagatcgcggtcaattagtgtcttatccgggcaattacgatttatatttaactacgaaagaagaaaatctacgtgttgaagccttgcaaaatgaattatttgataaacgtcttgcacaggaagaagtgtggattcgccaaggtatcaaggctcgccgtacaagaaatgaagggcgagtgcgagcattaaaagtgatgcgtgaggaacgccgccaacgccgtgacgtaatgggaacagccaaattacagttagatacctcaagtcgttctggcaaaattgtctttgaaatggaagatgtgagctatgaaatcgcaggaaaaaccttgttaaaagatttttcaacaacgattttacgtggagacaaaattgcgcttgttgggccaaatggctgtgggaaaaccacgttcattaaattattgctgggggaaattcagccaacatcaggaaaaatccgttgtggtaccaaattagagattgcttattttgaccaataccgtgctgatttagatcctgaaaaaaccgtaatggataatgtggcagatggtaaacaagatattgaaatcaatggtgtaaaacgtcatgtgctagggtatttgcaagatttcttgttcccgccaaaacgagcaatgaccccagttaaagccttatcggggggagaacgaaatcgtttattactcgcaaaattattactcaaaccaaataatttattgattcttgacgaaccaaccaatgatcttgatgtagaaacattggagcttttagaagaaattttgacggattatcaaggcacattgttaattgtgagccacgaccgtcaatttatcgataatactgccacagaatgttatttattcgaaggtaaagggcatttgaataagtatgtgggagggttctttgatgctaaacagcaacaagccaatttctgggcaagtaaagcagtggaagagcaggctaaagcgaagaaatctgaaccactaaaagaagaaagtgcggtgaaaaatgaccgcacttctaagccgaaatccgtgaaactttcttataaagaacaacgagagctagaacaacttccacaactattggaagagttggaaactaaaatcaccgtacttcaagctgaaatagccgatccagcatttttccaacaagctcacgatattaccgacgctaaattaaaagcattggcggatactgaagccgaattagaaacagcatttttacgctgggaagaattagaagaaaagaaaaatttggttgaaggtaaagcttaaaaaaataacgcccgaaagggcgtttttttatgtattttcaagatgatcttttttcaaaatattttcttcatcaagtattgataaacgagcgatagcgtttcgataagaaatttcaagggtttctctgctggttgccattacgccttgatccactaaaaatccatcatttacatcatatacccagccgtgtaatgagagtttttgtccgcgttcccaagcactttttacaattgatgtgcgccctagattgtaaacctgttccgctacgttaattttagttagcatatcggcacgtttttctggagaaagtttaccgagaagatgaccgtgtttaaaccaaatatcacgaatatgaagaagccagttgttgataagccctaaatctttatctgccatagcagcatgaatccccccgcagttggtgtgaccacagataataatatgttcaattttaagcacatcgacggcatattgcacaacagaaaggcaattaaaatctgtgtgaattacttggttagcaacattacggtgtacaaaaagttcgcccggttcaagatttgtcaatttttcagcaggcacacggctatcagagcaaccaatccaaaggtaatgtggcgtttgatgatccgcaagttctttgaagtaagtagagttttcttctttcattctttgcgcccaactgtaattgttggcaaagagttgtttaattttatccattttactttccttaaaattctgaaaaaattgaccgcactttggcgtaagtacggtcaatattaaagttaaattgaattagaaattcgcatttcttggtgcgcgtgggaatggaattacatcacgaatattttgcacgccagttacatagacaattaagcgttcaaaaccaagaccaaaaccagaatgtggaacactgccgtatttacgaagatcgcgataccaccaataatcatctggatttaatcccatttcttccatgcgtttatcaagcacctctaaacgttcttcacgttgtgaaccaccgatgatttcaccaattcctggggctaacacgtccattgccgccacagttttttcatcatcatttaaacgcatatagaatgctttaatgtcttttggatagttttttaccacaactggtgatttgaaatattcttccgctaagaaacgttcgtgttcagaagaaagatcaatgccccaagaaacagggaattcaaatttcttaccagattttaataacacatcaatggcatcggtatagtcaatttgcgcaaaatctgagtttacaaagttttctaaacgagtaataacatctttatctacatgtttttcaaagaattgtaagtcgtctttacgctctgctaatactgcacggaatacgtatttcaacatatcttctgcaagttttgcgttatccgctaaggttgcaaatgcaacttcgggttcaaccatccagaattccgctaagtgacgggtggtattagagttttctgcacggaatgttgggccaaaagtataaattttgcttaatgcacaagcataggtttcgccgtttaactgacctgaaaccgttaaaaatgattctttaccgaagaaatcttggctgaaatcaacttttccattttcactacgtggaagattttctaaatcaagtgtagaaacacggaacatttcacccgcaccttcagtgtctgatgcagtaattaatggggttgccacccagtagaaaccttgctcatggaagaaacggtgaattgcttgagataagcaatggcgaacacgtgcgaccgcgccaataatattggtacgagggcgtaagtgagctacttcgcgtaaatattcgatagagtggcgttttgctgccattgggtaagtatcaggatcttcaacaaaccctgtcacttccactttttctgcttgtaattcaaccgcttgtccttctgcaggtgattcaacgactttaccggttacaatcacagaacagcctgttgttaaacgtaaaatttcgctttcgtaattttcaatatcgttattaataatcgcttgaattggatcaaaacaagaaccgtcataaaccgctaagaaagataagcctgctttagaatcgcgacgggtacgaacccaaccacgcacagtgacggtttcaccaatcgccactttcccttgtaatacatcaacaattgatgccactttagacatattaaacctctgtaactgaatgtaattcatataaaattgccgatagtttaccttaatgaaggaaattttccataaaaatatagtgttggtgcgggttatgaacaataaaatcgccttaaaaatgagtcctaaataaaatagggtaaagccttattaatattgaatatacgcgattttatgttaaaatctcgggtcaaatcattatggctaataataggaaaaaatatgaaagttttagaaggctcagttgcagcacctaatgcaaaagttgcagtagtaattgctcgttttaacagttttattaatgaaagtttattagaaggcgcaattgatgcattaaaacgtatcggccaagtgaaagatgaaaatatcactatcgtgcgtaccccgggtgcgtatgagttgccattagttgctcgtcgtttagctgaaagtaaaaaatttgatgcgattgtggcattaggtacagttatccgtggtggtacagcacattttgaatatgtagcaggagaagcaagcagcggtttaggaaaagttgcaatggatgctgaaatccctgtcgcttttggtgtattaaccacagaaaatattgaacaggcgattgaacgtgctggtactaaagcaggaaataaaggtgcagaagcagccttaactgcacttgaaatggttaatcttattcaacaaattgatgcggcataaatcatgacagaacaaaaacaagtgaaaaagccttctgctcgtcgtcgtgcgcgtgagtgtactgttcaagccttgtattcttgggcggtatccggtaatactgcagaacaagtggaattagcctttgtgttagatcaagatatggatggggtagataaaccttacttccgtaaattatttcgtcaaacaatagaaaatattgaaaccgttgatttttcaatttcgccttatattgaccgcgcttttgatgagcttgatcctattgaaacggcaattttacgtttggctgtttatgaattacgctttgaattagatgtgccatataaagtggttatcaatgaagcgattgaagtggcaaaagtattcggtgcagatgaaagccataaatatatcaatggcgtacttgataaaatcgcaccagcattagggcgtaaataatccttttaaactgagaatggcgcgcgtttttaatgcgtgccttttcttttataagataggtggaaaaatggcaatgggtgaatttgatttaattaaacgatattttcagcaacaaatattagttgatgattccgttcaattatctattggcgacgattgtgcgctggtttccgtgccagagaattatcagcttgccattacgaccgatacaatggtggaaaatacgcattttttaccaaccatttcacctgaggacttggcttataaggcggttgcaacaaatttaagtgatcttgctgcaatgggggcacagccaaaatgggtttcactggcattaactttgccaaatgtagacgaaaattggatttcaacatttagccaaagtttattacacacgttaaaacaatacaacgtcacattaattggtggcgatactacaaaaggtaatttgtctattacgattacggcacaaggttttgtcgaaaaaaacaaaggaatttgtcggcataaagcacaaatcggtgatttaatttatgtttcaagcactttaggcgatagcgcggcaggtttaacacaaattttattgggcaaaagtgcggttgattctgatgatgtttttttgcaacaacgacatcttagacccacacctagaattgaacttgggcaggcgttaattggcattgctcatgttgccattgatctttccgatgggctaatatctgatttagggcatattcttgaacgaagtcaatgtagtgctgaagttgaattgactgcattacctctttcatcatcgattttaaataaatatgatcgcactcaagcggaacaatttgccttaagtggtggcgaagactatgaactttgttttaccataccgcccgaatataaagatgaattagaattacgcttgaaaaaactgaacgtgccttgcacttgtattggtaaaattaatgaaaagtgcggtgacttttctccccgttttttacgggatggaaaacctgtgaatataactttttcaagcggtttcgatcattttaaggaatcaaaatgacagaaaataatcctcttaaaaaaatctctcttttaaatcctattcatttacttgccgttggttttggctcaggcttaattcatcctgctcccggcacttgggggagcttagctggaacaattttaggtgtgattttactttccttattaggcgtaaaaatctttttaattttcaccgcactttgttttctactcggttgctacctttgccaaaaaactactgcagatatgggcgtacacgatcatggttctatcgtctgggatgaatttgtcggcgtatttattgtattagcagcgataccgtcattatcttggcaatggattttggctgcttttgcgttattccgcttttttgatattttaaaaccgtttccaattcgttattttgacgaaaaactcgaaaatggttttggcattatgatcgatgacgttttagcggcaatttatgctgtgattgttgtatttgctattcaatattggatgttgtgatgctaaatttaatcattgtgcatttatttggattaatgacgccagggcctgatttcttttatgtaagtcgaatggcggcaagtaactctcgtcgtaatacagtttgtggcattttaggcataacgcttggcatcgccttttggggaatgctttctatgttgggattggcggtgttgttcgttaccattccagcattacatggcgttattatgttgctaggtggtagttacctagcatatctcggttttttaatggctcgcagtaaaaaatacgctaaatttgaatcgcactctgatactgaatttaatcaacaaaccacaatcaaaaaagaaattttgaaagggcttttagtgaatttatccaatgcaaaagtcgtggtgtattttagtagcgtgatgtcgcttgtcttagtaaatatcactgaaatgtggcaaattatcttggcttttgcagtgattgtggtagaaacattttgttatttttatgtgatttcattgattttttcacgtaatattgccaagcgtttatacagtcaatacagccgttatattgataatatggcaggtattgtatttttattttttggttgtgtgcttgtttataacggcatcaacgaaataattcattaatagaaaaggaagtaacatgacattaaaaattgcaatcgctggtgctggcggaagaatggggtgtcaattaattcaagcggttcattctgcggaaggcgtagaactaggtgcagcttttgaacgcaaaggatcatctttagttgggacggatgcgggagaattggcgggaattggtcatcttggcgttgcagtttcagacgatcttgaaagtcaaaaagataaattcgatttattaatcgattttacccgaccagaaggcacccttgaacatattgcattttgcgtagcgaataataaaaaaatggtgatcggtacaacaggttttgatgaaaatggtaaagtggcgattaaagcagcttcagataaaattgctattgtgtttgcatcaaatttcagtgttggcgtgaatttagtcttcaagcttttagaaaaagcggcaaaagtgatgggggattattgcgatattgaagtgatcgaagctcatcaccgtcataaagttgatgcgccatctggcactgcactttctatgggcgaacatatcgcaaaaaccttaggtcgcgatttaaaaactcacggagtcttctgccgtgaaggaatcacaggcgaacgtaaacgcgatgaaattggtttttcaactattcgtgcttcggatgtggtgggggaacactcggtttggtttgcagatattggcgaacgtgtagaaatttcccataaagcatcaagccgaatgactttcgctaatggtgcagtgcgtgctggtaaatggttagaaaataaggcgaatggcttatttgatatgaccgatgtattagatttaaataatttataaatcaatttcaatgtcactttctacgtgacagcaacataataaaatctcatcaggttgaataaaggcaaggggcatttctttataagacaccttgccttttttgatcttaacgcgacaagaaccacaatagccactacggcattgatattcgtgatgaatattatttttctcgagatgatcaagtaaacttgtttcattattgaattctaatgtggtgttatggcggataaggtggattttcataataacgatatgttgtaatttgtcgtgctattatataaggaaaagatgaaattattgataaaaacttcacttagtcagtggatttgcttgaattttgccaaaatccctatttttaaaatgctaggttttataaccgcactttttattactgcttgtagttctattagcaaagaaccagtgaagacggtggatatttatattaaaccttattattcggctgaaaatggaaaagcagaaaatgtatttgtacataaagaaattgatcctatgctacgtgaaaatacgataaaaggttataaaagtgcggtgaaatttgtagaagaaaatccagctcgtatttcaccaatgacgatgttcacgttagctgctcgggcttacgattttggcttaagagatgaagctgttacttggttttatcgtgggcaaaatcgcttgatcaccgcactttatgtgttggatctaccaaaacaaacggtgcaggataatacagggttcagccatgttgtagggcagtttgttaatgcttatgcgttttgcaattttgataaacaaagtcttgctgccgaaaatgcaatgaaatggacagttgcgcatccttatgaagtggttttcttaccagcattacccgcaaaatttgcagatcgtcaaaaagcgttgaaagaagcagaagaaaaattagttcaacgtttacaggaacaagcccgtttttttgctaatccaaaaaataaagaaaaatggcaaaaagagcggtcagaaaattttgtgaatgaacgattttgttggtaacaagaaaaaatggaatagcgaatacgttattccattttnatttttgataagccaatgattttncgcattattcttttactttttaaggacttggtattatcattactcggttttttattttatagagaaaagagaagcaggggaaactatgcaacatctgaacgagcttgttgagaaagcgaaattagcgattgaatccattcaggataaaagtttaacggctttggatgaaatccgtgtcgaatattttggtaagaaagggcatttcacgcaattaatgcaagagttgcgtaacgtgtcagctgaagaacgtcctgcgatgggcgcaaaaattaacgaagcaaaacaagctgcgttagaatttttaaatgcaaaaaaaacggagtgggaacaggctgaacttaactcaaaattagaaaaagaacgtgtagatgtcagtttacctggtcgcaaagttgaaaccggtggcttacacccagttaccatgacgattaatcgcgtaacaaaatttttctcagaacttggcttttcagttgaaaatggtcctgaaattgaaagtgattattacaacttcgatgcgttaaatattcctaaacatcacccagcacgtgccgatcacgatactttctggtttaatccagaattattacttcgtactcaaacttctggcgtgcaaattcgtactatggaaaaaatgcagccaccaattcgcattatggctccaggacgtgtatatcgtaatgactacgatcaaacgcatacgccaatgttccatcaaattgaactactttatgtggataaaaaagcaaatttcacagaattaaaaggcttattacacgatttcttacgcgctttctttgaagaagatttacaagtacgtttccgtccatcttatttcccattcacagagccttcagcggaagtggatgtgatggggaaaaacggtaaatggttagaagtgttgggctgcggtatggtgcatccaaatgtgttgcgtaatgttggtattgatccgaatgaatattctggttttgcagtgggaatgggcgttgagcgtttaacaatgttacgttataacgtaacagatttacgttcgttctttgaaaacgacttacgtttcttaaaacaatttaagtaatttctcggatttgaattaaaaggataacaacaaatgaaatttagtgaacagtgggtaagagaatgggtgaaccctgcggtgtccaccgagcaattatgcgagcaaattaccatgcttggcttagaagtagatggcgtggaagccgttgcgggtacatttaatggtgtcgttgttggtgaagtggtggaatgtgcacaacatccagatgcagataaattacgtgtaactaaagtgaacgtaggcggtgatcgtttattggatatcgtgtgcggtgcaccaaattgtcgtcaaggcttaaaagttgcttgcgcaacagaaggtgcggtattacctggcgatttcaaaattaagaaaacgaaattacgtggtcagccatcagaggggatgctttgttcattttctgaattaggtattgatgttgaagctgatggtattattgaattgccacttgatgcaccaattggtactgatttacgtgaatatttagctttagatgataatgccatcgaaattagcttaacgccaaaccgtgcagattgtttgagcattgcaggtattgcgcgtgaaattggtgtggtaaataaacaactcgtaaatcaactgcactttgaagcagcgccagcaacaatttctgataaagttcaaattgatttacaagcaccagaagcttgcccgcgttatttattacgtgtgataaagaacgtcaatgtaaaagcaccatcgccaatgtggatgcaagaaaaattgcgtcgttgtggtattcgttctatcgatcctattgtcgatattactaactatattttgcttgagttcggtcagccaatgcacgcgtttgatgcggctaaagttacacaacctgttcaagttcgcttcgcgaaagagggggaagaattagtattattagatggctcaaccgcaaaacttcaatcaaatacgttattaattgctgaccaaaatgggcctttagcaatggcagggatctttggtggtgcagccagtggcgtgaatagtgaaacgaaagatgtgattttagaatccgcatttttcgctccattagcgattgcaggccgtgcaagacaatatggtttacatacggatgcatcgcaccgttttgaacgtggtgtggattttgaattagcgcgtaaagcaatggaacgagcaacggcattattacttgaaatctgtggtggtgaagcaggtgagatttgtgaagcaagcagtgaaactcatcttcctaaagtcaatacagttcaacttcgccgtagtaaattagatgcacttttaggtcatcacattgaaacaggaagcgtaacggaaattttccaccgtcttggttttgatgttacttatgcaaatgatatttggacggtaacttctgcaagctggcgttttgatattgaaatcgaagaagatttaattgaagaagtggcgcgtatttatggttataacagcattccaaacaatgcgccattagcgcatctctgcatgcgtgagcacaaagaatctgatttagatttagctcgaattaagaccgcacttgtggatgcagattatcaagaagctattacttatagctttgtggatccaaaaattcaaagtttattacatccacatcaagaagcacttgtattgccaaacccaatttctgtggaaatgtccgcaatgcgcgtgtctttaatcagcggtttattaggtgcagtgctttataaccaaaatcgccaacaatcccgtgttcgtttatttgaaacaggattacgttttgtgccagatgccaatgctgaatttggcgtgcgtcaagaatttgttttaagtgcggtgattactggaacggcaaaatctgaacattgggcaggtaaagcagagtctgtagatttctttgatcttaaaggcgatttagaatcagtactttctttaacagaaggtggtcatagagttcgttttgttgcaaaacaatttgatgcattacaccctggccaatctgctgctattgaattagatggtcaagaaattggttttattggtgcaattcatccatctattagccaaaaacttggcttaaatggcaaaacttttgtatttgaaattctttggaatgcaattgcggcacgtaatgtggtgcaagcaaaagaaatttctaaattcccagcaaaccgtcgtgatttagctttagtcgtcgcggatagcgtaccagcaggggaattaatcgcagcatgtaaacaagcaggtggcgaaaaattggtgcaagtgaacttgttcgatgtatatcaaggtgtgggcgtcgctgaaggctataagagtttagcgattagcttgactgtccaagataatgaaaaaacacttgaagatgaagaaattaatgcagtgatttcagcagtattagcggaggtaaaacaacgctttaatgctgaattaagggattaatatggctacgataactaaacttgatattattgaatatttaagcgataaatatcacttatctaaacaagatacgaaaaatgtagtggagaactttttggaagagatccgcttatcgctagaatctggtcaagatgtgaaattatcaggatttggtaattttgaattacgcgataagtcatctcgcccagggcgtaacccaaaaacaggtgatgttgtgccagtttctgctcgccgagtagtgacatttaaacctgggcaaaagttacgtgcccgtgtagaaaaaactaaatagtaagcaacaaaaagtgcggtgaatttctaccgcacttttcatatgaaaaggtatgaaagtatataaatcatttttaatcgctactgcatcgctgtttttattcgcttgttccagttttcaaaacgatgattatgcgatgaactataaaggtcaaatcggcgaacctattatggccatagccatgttgagcgaacaacaacatgaatgggcaggtacaccttatgtgctcggcggcgtttctcgtcgtggggtagattgttctggttttgtgcagaaaactttcttcgatcgttttaatcttcgtttgcctagaagcactgttgaacaagctaattatggtaaacatgtacgcaaagaagatattcaaactggcgatttaattttctttaaaactggcagaggccctaatggttatcatgtggggatttatgtaaaagaagataaattccntcatgcttccaccagagggggagtcgtctattcttcaatgaataacccttattggtcgaaagccntctggcaagtcagacggatttaaaaagtataatgctggaattttccagcatttttttattgttttttcaactgctagaaaataaaaaccattaaatttatcttcaattattatttctgtganccatctcacaatcttaatatgacaattatcataaccctttagagcgcgttatattatctttatgctgtgttagtcgatatgggagaacaatatatgcttacgacgatactcagcttcctcattgtaaccactgtggttgcgtatgtttcttggttaaaaacaaaaggggatgatttaaaatcttcaaaagggtattttttggcagggcgtgggttaagcggtttagtaattggctgctcaatggtgctgacatcgctttcaactgaacaacttatcggtgtcaatgcggtgtcctataaaggtaatttttccgtgattgcttggacagttccaacggttattccgctttgtttcttggctctttatataattggctggctataacacttatgttgtaggaaagtggcacgtaggtacgaaatccgtacctgaagattacgggattaaaggccataactttgatggttatggctatcctggtagtggcgtatataaaaatttagtcttcaaccaaccgccaacacactctaatcgttataaagaatggttagaagaaaaggggtatgaaatcccagaagtaagccgcgcctactttggagataatccgcatttacgggtacaagaactttgcggtttactctcaggcgcaaaagatcaaaccatcccttatttcatcattgatgaagcgaaaaaatatattcaagaatcattagatgaaggcaagccgttctttgcatggataaacttctgggggccgcatacgccttgtattgtgccagaaccttattattccatgtatagaaaagaagatgtggtgcttgataaaagtttctttacaccgttagagggcaaaccagaccatttccgcacaatttcaaaaatgtggggaatgtgggaggcgagcgaagatcattggaaagaagtcatcacaaaattctggggttatattaccttaattgaagatgataaccttgtttatcttcacgatttaacttcaacagtgttcgatttagccaatcaaaaagtgccagaaagttttgaagggcagagcgttcttccgattatgcgccaacaccaagataaccaacgaaaaggtgtacttggtcagctcgcagggcattttgtgtattttgaacagcgtatgtggcgtcgtaaagattacaaactcgtatttaatgcgactgatgtttgcgaactttacaacatccgtaacgatccagaagaaatgcacaatttgttttatgatcctcaatataacagaatcaaaaaagagatgttggaagaaatgcgtgcagagatgaaacgtctgaatgacccactggaaaattgggtttatcgaattattgacgaaatttaatcaaagtcgtagattaagggcgtatctgatacgccctttgttatctctgcaccttatttatcttttaaaataggaataaacatgaaaacaacattactaaaaacactgacaccagagcttcatcttgttcaacataacgacattccagttccttcacttaaaacatgcggttggaacaccaaaaatttcccctgcaaggggcacagcttatcagttggaancccccaaaatgcgaagcaagatgtattatggctaagtgaagtagagccattcaaaaatggcaatgctattcgtggtggtgtaccgatttgttatccttggtttggtggcgtaaaacaacctgcgcacggtacagctcgtattcgtttatggcagttgagtcattactatatttcagtgcataaagtgcggttagaatttgagttgttttctgatttaaatattatcgaagctaaagtctcaatggtatttacagataaatgtcatttaacttttacccattatggcgaagaatcagcccaagcagcattacatacctattttaatattggggatattaatcaagtggaagtacaaggtttacctgaaacttgttttaatagcttaaaccaacaacaagaaaatgttccgtcaccgcgtcacatttctgaaaatgttgattgcatttattctgcagaaaacatgcagaatcaaatcctagataaaagtttcaatcgtacaattgcactgcatcatcataatgcaagccaatttgttctttggaatccttggcacaaaaagacgagtggaatgagtgaaactggctatcaaaagatgttgtgcttagaaactgcacgtatccatcacttgcttgaatttggcgaaagtttaagcgtagaaatttcgcttaaaggctaaattttgttgcataagtggtgtgaatactatagaattcgcgagactttgctcgttccttgcgggcaacaaatttgaaatcttttatttttagcgaaaagatttttactattaaccaatagaaggaatacgattattaaaaccgtaaaaaaagcaccggcagtaaatcgcccaaaccgtatcaatgaagagattcgtgtaaaagaagttcgtttaattgaccaaaatggtgaacaagcngggattgtttctattcaacaagccctagaaatggcagagcaagcagagcttgatcttgttgaaattagcccaaatgcagagccgccggtttgtcgcattatgaactacggtaaattcctttacgaaaaaagtaaaaccgctaaagaacaaaagaaaaaacaaaaagttgtccaagttaaggaaattaaattccgcccaggcacagacgaaggtgactatcaagttaaattacgtagcttaatccgtttcttagaagacggtgacaaagcgaaaattaccgtgcgtttccgcggtcgtgaaatggctcatcaagacatcggtttagatgtgttagagcgcgtaaaaaatgatttagctgaaatttcagtggttgaatctgcaccaggtaaattagaaggccgtcasstgtaatggtgttagcaccgaagaaaaaataagaattttgctgagatttttcagcaaatctttttgtttaagtttgacttaaatgaaaagacaactgcatgttgggcacactacgcagcctaactgcttttgaaaaggcgatttaatttgccttatgatggaaatgatcagtgcttccaagtaactttataagttcgcctgattatgttgttttaaacgaaaaatgcggagttattttaacaatgcctaaaatcaaaacagtacgcggcgcagcgaagcgcttcaaaaaaactgcttctggtggtttcaagcgtaaacaatctcacttacgtcatatttttgactaaaaaaacactaaacgtaaacgtcatttacgtcataaatcwatggttgcgaaagcagaccaagttttagtagtagcttgcttaccatacgcataagccgttatttaagcaaaacgtacgattagttcattnttagaaaaatattacataggagattaaataatggctcgtgtaaaacgtggtgttattgcaagagcacgccataagaaagttcttaaggctgctaaaggttattatggtgcacgttcacgcgtgtatcgcgttgctttccaagcggtgatcaaagctggtcaatacgcataccgtgaccgtcgtcagcgtaaacgtcaattccgtcaattatggattgcacgtatcaacgctgcagcgcgtcaaaatggtttatcttatwgcaaatttatcaacggcttgaaaaaagcatctgttgaaatcgaccgtaagattcttgctgatatcgctgtwttcgacaaagtagcgttcgctgcattagttgaaaaagcaaaatctgcactttaattttttaaagtttagataaagaagaattaggacgctgaaaagcgtcctttttttgcacttatgactttaaattttgtaaaataatgccattagttctcatctgttaaaatctatggccgaaacaatcccactgaatcctatcacgttgcctttaaatcaaattagcttaatcgaagcatctgctggtacggggaaaacctacactatcggttctttatatctccgacttttattaaaggctggagaaaataacttttctcgtccgttaaatgtggaagaaattctggtggtaacatttacggaaatggcaacagaagaactcaagaaaaaaattcgtgagcgtataacagatgcgattaataaactcactgcctttgctaaaacccaagataaatccgcatttaaaaatgatgaatttcttaccgcactttgtgataatttgaacatttttgaggcaattcatcgcttaaagttagctgagcaaaatatggatttggcggcgatttataccattcacggtttttgtcgccgtatgttgatgcaatatgctttccattcaggcattcacttcaatttagaattaataaaagatcaatctgatttgttagttcgttttgctaatgaattttggcgagaacatttttatccgttagattttgaatctgcgaattttatcgcgacagaattagtatcaccagcaaatgtgttgtctttgttgaaagcggatttaggtaaagatttgcaggtggagattgaaaataaacaggcgttatctgtaccaatacaaatctttttaccgcaatatcttggtggttatcaaaaggcgttgaatgaattaaaggcattttggttagaaagtgcggatgaaatttcagcgattattacaaatgagctggttaaagattatccaaaagatcagttgaaatcgttaaatcgtaaaaagtaccaagtaaagcgtttaggggattggattaataaaattaatcaatggtcaaataatcctagagattatcaaattaataccacattgaaagactatttcctacaatcatctattgagaaaaattgcgaagaatcaacggataaaaataaagataaaaaacccgcaacgcctttttattccccgatttttgcagatcttgaaaagcgcgttaatgccttaatgacaccagatttactaagcaaactcactctttatcattatcgccaaggtctacaacaaaaacttttagactataaactaaatcatcaagaaaaatcctttgatgatttattgcgtttgctttgtgaagccttgcaagatgcgcaaggagatgaattagcggaaatgattcgcttccaatatccttttgcgatgattgatgaatttcaggatacagattcacaacaatacgctattttttcaaaaatttatcgtgataatcccgaaaaaaatactggttttattatgattggtgatccgaagcaggcgatttatcgtttccgtggtgcagatatttttacttatctaaaagcatcggacgaagcccaatctcgctttgaactcactaaaaattatcgttcagagaagcatttggttgatggcgtaaatgctttattcgattttcctcaatcgccatttatttatcaaaatattaaatttactgctgttgattctcgtgatgatcatcttcgattttatttaaatggtaaagttgaaccagcttatcgtttttatctaactgaaagtgacaaagtgaataaaactgaaatggcaaaaatatgtgctatttctattcaacattggctaaaaagtgcggcagaaaatcaggcagtttttcaaaatgaagatacctataaaaccttacaagcggcgaatattgccgtattggtgcgtgataaaaatgaagcggctttagtaaaaaatgaattgcaaaaattggggatcgcgtcggtttatctttctgatcaaaatagcgtatttgatagcaatgttgcgaaagaattagcttgggtacttaaagcctgtttgaatgtggctgaacgcccaattttgaacgcaattgcgaccgcactttttggcttaaatgcagcggatattcatcaaattcagcaaaatgaggcagactggcaacgttgggctgatagctttgctcaataccaacaaacttggcaacgccaaggaatattggcaatgttacatcaaattttattggagcaaggcatttcagaacgcttattaagccaagccacgggcgagcgagatttaacggatttcctacatttggcagaaattttacaacaagctgccacgctacacgaaagtgaagcggcattgctcagttggtttgaaaaacaaattcaaggcgaagctcgtcaagaggctcaaattcgtttagaaagcgaacgccaattggtgaaaattgtgacaatccataaatctaaaggcttagaatatgatttagtttggctaccatttttagctgcgccgagcaaagatccaagtaaaaaatacatcaatatttattattctaaagaacgagatgaaaccttatgggatatagaaaatcgcaatttaaacgctctttgtgaagaaacttttgcggaagagttacgtttactttatgtggctttaacgcgtgccaaatatcaaatggcattcgctttgcctgcgcaatttgataaaaaatggaatgccttgcattatgtactaagccaaggtgaaataggcaaggaaataaatttgtcggattctaaagataccgaaacattgttgcaaacctttaaagaaaaaatgcaagataatgtggaaatctgtactaagccaaatctagaggctttgccgaccttatcaattaatacaaaaaatgatgattttaaagcctcagaatttacgggcaatattgagcaagattggcgaataaccagttttacttcaattgaacaagcacatcgccgacaaaattatttcactgaaagtgcgggtaaaaaacacgctgtttttgatgacgcaaaagattacgatagtcaaaatgctattgaaatttccaccgcacttttaaacgaaaatgaatcaaatattttagatttaccacgaggtaaacaagtcgggactgcattgcatcgccattttgaaaattgctatttttctgacttggcaaatacagaagaaattgacaaattaagacaatccttacagttagatgaaacttttacagagtcgctacaaaattggctacaacagatttcacatacaccactttctaatgaaataggaatagcattagctgatttagcaaataaagattgcattaaagaaatgccattttatctggctattcgggaacattttgatgttgaagcgtttaatcacacgttgaaagcgcatcatcatttgccaagcgagtcacttcaatttgaacaaattcagggcatggtgcgaggttcgattgacttagttttccgccataatggaaaatattatcttgttgattataaatctaatttcttaggttcaacccttgctgattacaatcaagaggcattgaaaaaagaaatgttacacagtcactatgattggcaatatttaatttatacgctggcattacatcgttatttacaaagtgttgtgcctcattacgattatgcacgagatttcggcggggtattttatcttttcttacgtggaatgaacggtgagccacaatctggcgtattttacgatcgtccaagcgttgaattaatcacagaattagacggggtgttttaatgttatctgtattacacaaacttaaagagctgcgcattctttctcaaggtgattattattttgctaagttgatagctgataaacaatgtcatacggattatgcggaaccagtcaaaaatttagccatattattagccgcactttgtagttggcgttatacgcagggaaatacttgcagccaattagatcgctatttagaacataatttatttggcttggcttatcgcactacagaagaagattatttagctgaaattcatgaaaagattggttatttacccgttgaagattggcaaaatgcgttgtgcgggcatatggcatttacgcaagatcccgtcaatcaaattgcaccaatggcatttcaatttggcgcgttgtatttctatcgcgcttggcaagatgaatatcgcatcgtgcaatatataaaaaataccttaaaaaaataccgcactttagccttttcttatgatgaaattcatcaaaaattagagaaatatttccctgaaaaacaggaaaaaacagattggcaaaaagtggcagtggcgacagcgattaaaagtccattttcgattattacaggcggcccaggaacaggaaaaaccacgacagttacgcgtttattgctcgttctacaagaattatttgattgtaaattacacatcaaattggttgcgccgactggcaaggctgcatctcgtttggaagagtcgattaaaaatgcgttaggttttatgcaagaaaaaatgaatgtatcccattcacttttcaatgcgattccacaaaaagccagcaccttgcatagtttactgggcgtgaatgcctttaatgattacacacgatataacagccataaccctttgcagttggatgtattagttgttgatgaaacatcaatgattgatttaccaatgatggcaaaacttatcaatgcattaaagcccgaaactcgattaattttattaggcgatcaggcgcaattagcctctgttgaggcgggggctgtattgggggaattggctcaatttgttactcaaccttatagtcatgaacaagccgcatacttactagcaacaacaggctacaaagtagaaggttccgattgttcaaatccaatacgtgattgcttatgccatctaacagaaagtcgccgttttgataaagattcaggcattggcaagttgtccgaattcattcaaaaaggcaaagcagacgatagccttgagttatttgaccattatccgcaagaattgcactttaattccttaaatgatgaaggcgatgcggtcaatcaagtggtaaaaagtgcggtggaaaattaccgcactttcttaaaaatgttggacgatttacgtaaacaaaaaattgatcctaacgctaaaaatgaacaaggcatttcctatgccgaagctattcaagtgcaatttaattctgtgagatttttaaccgcacttcgtaataacaatttaggtgtcgaaaatctcaataaagaaattgcgttagcgttgcgagagcaaaaattgctttggttccgtaatgaacaagattggtatatcggcaagccaattatgattactgaaaacgatcataacgttcgcctttataacggcgatattggactatgcttggcaaatggcaaagtatggtttggcaatcgagaagtgctgacaaaccgaattccagcgcacgaacccgcttttatgatgacgattcataaatctcaaggttcagaatttaaacataccgtcatggtgcttccaacagaagtaaatccagtattgtcgcgagaattagttttcacgggtgtcactcgtgcaaaaaaagaacttactgtatttgctgatgaaaaaatatggaaaacagcaattcgccagaccgtcaaacgccagagcggattgggaaaattattggaagatttaaattagtaaaaggcggtaaatttggaagataaatcaatcagataatctccatttaaaataacttttggggaagattattttaataaattcttcaaactggttttcattgctgccatttgattttcaaattgtgccttgctttctctttcgtcaatcatataggtaattgtttccgaaagcgtcatcttcatttttcgagaatatttagaaagacgtagccaaacagcatattccaaatcaatggattttttcttggtatgttgtttttctccattaaaaaagcgtttacggcgggcacgaatggcttgatcaagcttaattggtaaggctggagaaagatgatttttaatccattcttcaattttttcaggataattttgggattctaataattcttgggctttagcttcttgcaaactacgttcttcgtagcgagtaatattttccccttcgcgatgtttacgaattaggtaaatccatttccaatttgcttcttgattttcgagtttttggtatttcattttttatcattgagtgacgtggtaactgcattaatatacgtgtttttatgccgattttctagtggattttcacaaggctattaaatatgcgataatgtggtcaatttttctagaaagagaccagccgtgagttcattattttctcaacaacaagctattgagcaatctttaaattggcaggcattacaacctgatttggtaattcaagattttcctttagaaccagtgaatttctgggcgttacaaccgaatgctacacagggtatcgatttatttttacgtcatccgacacgttccttgctaatgatgaaagtgggcgaacctgttgaatatgcggagttattacaaaattttatatcgcaaaatcatcataaagtgcggtcaatttttggtgtaaattatgtgatagagcagggcgactctttttcttttcctcatgtttatactgagccagcaaaatctttagatgataattttgctagtcaaggggaggcgttaagcgcattgtattgcgatcaattccagcttttcggtagttttcggattcatccacgttcacaagatattcaattagtgccgggattggtgcataaggctaatggtggcgttttgattttaagtgcggcaacattgttatctcaatttgatttatgggggcgattaaaacaaattctgcaaacccagacttttgactggtattcagcccatccatttaaaaatttaccttgtgatataccaagctatgcgctgaacttaaaagtgattgtacttggtaatcgtactgaattagccactttggctgagttagaagaaaatctttattctttcgccgattatgctgaaattgaaagttatatttctgtagctgaagtggaggaacaaaaaacttgggcgggttatgtacaacaaatggctcaagagcaaaatattgagctagattttcttgctttaaataaactctatcaattattagttcgtgaaagtgaaaatcgctttttaattaatgcatctcctctcaaattaaaagaaatattacaggatgcctcaacttttactgaaaaaacagcattaagtgcggtggattttgagggtatttttcaacaaaaattagcgcaatatggtttcttaaaagaacaaacttatgccgatattttaaacgagcaagtttatgtcgaaacgcaaggcgaaattgttggacaaattaatgggctttcggtaattgaatatcctggtacgccagtatgtttcggcgaaccttcgcgtattagttgtattgtgcaatttggcgatggggaagtgattgatgttgaaagaaaaaatgaactagcgggaaatattcacggtaaaggaatgatgattgctcaggcttgtctttccaatatcttagatttgccctcgcaattgccattttctgcatcattggtgtttgaacagtcttatggagaaattgatggcgatagtgcatctttggcgattttttgtgtgttagtaagtgctttagccgatttgcctttgcctcaacatatcgcaattacaggatcaattgatcaatttggacttgttcattctgttggtggtgtaaatgataaaattgaaggcttttttactatttgccaacgtcgtggtttgactggaaaacaaggtgtaatcattccaatgacaacaatccagcaactgagtttatctgatgacgtgaaaagtgcggtaaaaaatggcgagttttttatttatcctgtggaagatatttatcaggcttgtgaattgttatttgggcgtgatttgttagatgaaaacaaagattatacagaaaaaactgagtctttatctcgtcttattcaacgtcgtattgagggacgtgccgattctgaacgaaaaagtttttggcattttttccgctcctaatagagaaaagcgagcattttttcgcttttctttttttctataatttctaagagtgactgctccgacaagttttgcgaacaagtgttagctatttacagtttactgcgttccttttaaaataaatatatcagttataaactggatttatcatatataaaggaatctgaaatgcaaaacgcttgtacacttaataaaaaaagtagttattcttatgatgatttgctcgcgtcaggtcgcggcgaattatttggtaaagaaggcccgcaattacccgcgccaacaatgttgatgatggatcgtattattgaaatgaatgaagaaacaggtgctttcggtaaaggatatattgaagccgaacttgatattaaacctgaattgccgttctttggttgtcatttcattggcgatccagtaatgccaggttgtttaggattggatgcgatgtggcagcttgttgggttttatttaggctggattggtggcaaaggaaaagggcgagcattaggggttggagaagttaaattcacaggacaaattttgccaacagctaaaaaagtggtgtaccgaatccatatgaaacgagttattaatcgtaaactagttatgggaatggctgatggtgaagttgaagtagatggtcgtgttatttataccgcgacagatttaaaagtgggactattccaagatacctcaacattttaatttttctttattaantcatacaaaagtgcggtgaaagtttttcctagattttcaccgnacctttacttattaaattgtaataaatttttaaaatatctataatattcttgttattttttaattttattagtggtaaataaagtttattttaaagtttttaataaacgttattatagaaaatattaaattaatttctatttaaattataaataatatactaaagtagtgggaatatgatggtaaatgatgattttcaagaatatgtgaagcaactggtaacaaaacatcgagatgaacgaatttatccttttcaatatgaaggaaaaaaatattggttgaagcaacctgaaaaattgaaaggtatttggctattattaaaaccccatcctaaaaaatcttttaaaaatgaattatatactttattgaagcttgctgaacaaaatgcgccagtgccaaaagtctcttattatagtgatcatttttttgttttagagaatgtgggacttaccgtatcacaatggctatgtaataaaaatatagatgaacaacagaaatttttaattatttatgatgcttgtctcgctttgattgatttgcatgctaaaaatttggtgcatggtcgtcctgctattcgagatattacttgggataaagggaaagttacttttcttgattttgaatctcgttcaaatagccgaaatcaaaattgggtagttattcgggatatgttatttttctttgatagtttatgtcgagaagaagatatttcggacacttttattcaaaaagtagcgttgtattatcaaacacattgtgaagcgaaaaattggcaaaatatgatcgtatttttgcaacgttttagctgggtttattatcttttattgccttttaaacctattgcaaagacagatttaatttcgatttatcgcttatttgaaattttcttgataaagaaaaaatgatgaagaaaatattttttatttttgcattatcaggcatattagctgcttgtactgtgggtggtggtgttagtgctggtggtggaagtaatggtgtaggattaggtgtggggattggatctggtattcgcttctaataatgaaaagtgcggtaactttaatctttatcttgcatttgaacttattcatcgttagaatgcgatttccttgtcatcgctgagttagagatcggcgaatgatgtattaacaacactaccttttaggagtaaaaaatgtctctaagtactgaaaaaaaagcagcaatcgttgctgaatttggtcgtgatgcgaaagataccggttcttctgaagttcaaatcgcattattaactgcacaaatcaaccacttacaaactcactttgcagagcacaaaaaagaccaccatggtcgtcgtggtttattacgtatggtttctcgtcgtcgtaaacttttagactacttaaaacgtactgatcttgctttataccaaagcactatcgctcgtttaggtttacgtcgctaattttttattacgatagtaaaaaatcaagccctcgaatattgagggcttttttatggggctgtactagataactagaccaaactccccttaactaattgttttaaaatggaaatttgagattttatttcgctattgttaaaacgccattcacattcttttaaatacagctcaaaatgctctttgggaatgccattaaacttctgtaaatggcgttttgcgtgattccaaaaattcccaattccgtttatgtagttgtgattttcagcaaaatgcgtgctgtgattgatgcgaaaatggctaaattcactgacatcaagcacatcataactacgaaaggtatccgtgtacacaatgctatcaggcttaactttctctcggataattggcaataatgttgctgattgcacattaggaacaacgacggtataaaccttgcatttcatttgagaagcccgaatactgcgactttccctgcaacactgcgaccacgtttgccttttcgagtactgccgaaatagctttcatcggcttcaattttgccttcaaacatttccaaatgtgggcttgtttgataaatgagtaagcgtaatcgatgaaagtaatagtggctgtatttttgtttacattaaccaatttactggctgttcttgctgtgacacctgcgacaaacagttcaatgagtttattttgtttatgctgacttaagcgactttttctcattggtttattctaacctaaatgggatttttagttgttatctactacagcaccttaatatttatagagttcgttatataaattacgctcgaattgtactaatggggcacgttttgttttgctttctaaatcgccagttgagtagccattaataaattgtacaaatgccactttttcccctcgcgcatttgtcataaagccagctaggttataaacgcctttcaaagaaccagttttagcaatcacgtttttcactaatggcgggctaattaatccacctcgcccactgatcgtgccatctacacctgcgatggggaaagtttccattaaatgtagtttatcttcgtttttggcgatgtattctaaaacggatagcatcgttttaggtgccacaagattatggcgagatagacccgaaccatcggctaaaatgctattaccaaaacgaattccttgtttttgcaatatggatttaaccgctaatgtgcctaattgaaaggaggcggggcgtttatagtaattgaatgccaccgctcggaataatgaatcggcaatttggttatcggattttttcatcatttttttcaataaatctggtaatggttttgataaatgtttcgctaatagctgaccttgttgtggtttttggggtaacaagactttgccattgaactcaatacctaattgtcttaattgacgttgaataatctcagcagcataagcatccgtattttgcacggcaaaacttaagccaaaaggtttatattgacgggctaaacatccttttacttgatagcgattattgtcgtgtacaacaacatcgagctgacaataaggcgcttcattgctatccgctacataaacttgtccgaacacttgaataggaaattgtgcaggcacattaatttttactatttcacctggatttttattcgcatctagttccgcataaaaacagttgttatcaatatttgcagctgctggtggagagttgaaacacattgtgagatcgttccaaatccaacctaatcctcggtcgtgactagaaaaaacagaggtatctaatactaaatcgccattaatttttttgatgccttgtttttttaattcggcaagtaagctataaagctgacctcttgtgagatcaggatcgcctgtgaaacgcacgattaagttgccatctaaattcccattttgaattttcccattactcaaaagtgcggtctcaaattggaattgatcgtctaatgcaagtttagcggcaacggctgtaaaaactttttgtgtgcttgcagaaagcataaaggttgagccattataatcagcaataatttggttttgatttatatttttggcgatgaaacctacgttagagccttcaggcagtttttgtgttaaatctgaaacattaatattggcgaaggttggaaggctaaaactcactgaaagtaaaaaggaaccaagtgcggtggaaattgaagataattttttcatattaggtttgttatggttgctatttttttttagacgaacaataataagccccgaatgaaattgagtaaattattttctcatttcaagtttatttttgataatactgcagtaagattttagaattttactgtggtttttgttttatttagtaaaaggaaaaacaatgcaacaaattccaatgactgtgcgtggcgcagaacaattacgagaagaattggatttcttaaaaaatgtacgtcgtccagaaattattaaagccatagcagaagcccgcgagcacggagatttaaaagaaaatgcagaatatcacgcagcgcgtgagcaacaaggtttttgtgaaggtcgtattcaagagattgaaggtaaacttggtaatgctcaaattattgatgtctcaaaaatgccaaataatggtaaagtgatttttggtgcaacagttgtgcttgtaaatacaaatacagacgaagaagtcacttatcgcattgtaggcgatgatgaggctgatattaaatctggtttaatttcggttaattcaccaattgcgcgaggcttaattggtaaagaattagatgataccgttaatattacaacgcctggtggtgtcgttgaatttgatattattgaagtgaattatatttaaataaaaaagtgcggttaaaaatgaccgcacttttgttgttatttgcgtggaagctgaatttttgcttcttcgcttgggcgataaagtaccaaaatatgcccgatagtttgtacttgtgctgctttagtttcacgcacaatcgcattgataataagttgttttgtttcacgatctgcaccagcaacttttactttaatgagttcgtgatgattaagtgcattttcaatttcagcaagtacacttcggttaagccatttccaccaagcataacgactgggttaagatggtgcgcaagaccttttaaaaattgtttttgtttggttgataaggttgtcataaggattcctaataaaaaagagcggttgattttctcaatgttttttactgatttcaattagcttcggcttgaatttgacagattgtacccaaatataggcgaaacgactacaaaaaatagaagattatgggaaagaaaaaacgttcagcgagttcttctcgttggctaaatgaacattttagtgatcaatttgtgcaaaaagcacataagcaaaagttgcgatcacgcgcttattttaagattgatgaaattcagcaaacggataaattatttaaacagggaatgaccgtggtcgatctcggtgccgcaccaggcggttggtcacaatacgtagtaagccaaattggtggcaaaggtcgagtgattgcttgtgatattttagaaatggatcccattgtaggcgttgattttctacaaggtgatttccgtgatgaaaatgttttgaatgctttattagcacgcgtaggcgaagataaagttgatgttgtgatgtctgatatggcaccaaattttagtggaatgccatcagtggatattccacgcgcaatgtatttggtcgagcttgctttagatatgtgtaaacaagtcttggcaagcaaaggaagttttgttgttaaagtctttcaaggggaaggctttgatgaatatttaagagaaattcgttctttatttgatgtggtaaaagtgcgtaagcctgaagcatcacgtggacgatctcgtgaagtatatattgtggcaacaggctataaaggataattgctttgatagcttttcattgctaatgatgtgtagtatcttgtgacgaaattttttaacttaggaaaggtaggttagactttgaacgatatggtcaaaaatctagtgctttgggtggtagtggcagtcattatgatgacagcataccaaagtttcaattcatcttcgggtagaaaattctactgattatacaacctttgtttacgatgtaagcaacggacaagtgacagcggcacgttttgatgccaatgaaattacggtaacgaaaaccgatggttctaaatattcaaccgtaatgccaccacttgaagacaaaaaattgcttgatgatttattaagcaaaaaagtcaaagtggaaggcacgccatttgaaagacgtggttttttatcccaaattttaatttcttggttcccaatgttattccttgttggtgtatgggtattctttatgcgtcaaatgcaaggcggtggcggcaaagcgatgagctttggtaaaagccgagccaaaatgttgaatcaagatcagattaaggtgacttttgcggatgtggctggttgcgatgaagcaaaagaagaagtgggggaaatcgttgatttcttgcgtgatccgaataaattccaaaatttgggcggtaaaattccaaaaggtattttgatggtagggcctccaggtactggtaaaactttacttgctcgtgcgattgcgggagaggcaaaagttccattcttcactatttctggctctgatttcgtagaaatgtttgtaggtgttggcgcatcacgtgtacgtgatatgtttgaacaggctaagaaaaatgcaccttgcttaatcttcattgatgaaatcgatgcagtgggtcgccaacgtggtgcgggcttaggtggcggacacgatgagcgtgaacaaaccttaaaccaaatgctagttgaaatggatggctttagcggtaatgacggtgtaattgttattgcagcaactaaccgtccagatgtgcttgatccagctttaacccgtccaggccgttttgaccggcaagtagttgttggcttacctgatgtgaaaggtcgtgagcaaatcttaaaagtgcatatgcgtaaagtgtctgttgcgcaagatgttgatgcaatgacgttagcgcgtggtacgccgggctattctggtgcagatttagcaaatttagtcaatgaggcggctttgtttgctgctcgagtgaataaacgtacggtaaccatgcttgagtttgaaaaagcgaaagataaaatcaatatggggccagagcgtcgcactatgattatgacggataagcaaaaagaatccactgcttatcatgaagctggtcatgcgattgtggggtatttagtgcctgaacacgatcctgttcacaaagtgaccattattcctcgaggacgtgccttgggtgtgacattcttcttacctgagggcgatcaaattagtattagccaaaaacaattagaaagtaagctttctaccttgtatgcgggtcgtttagcggaagatttgatttacggcgaagaaaatatctcaacaggtgcatcaaatgatattaaagtcgcaactaatattgcgcgtaatatggtaacgcaatggggattctctgaaaagttaggtccgattctttatacggaagatgagggcgaggttttcttaggtcgttcaatggcgaaagcgaaacatatgtcagatgaaactgcgcattcgattgatgaagaagtgcgtgcaattgtaaatcgtaactatgcgagagcaagagagattttgatcgacaatatggatattcttcatgcgatgaaagatgcattagtcaaatatgaaactattgaagaagaacaaattaaacaattgatgaatcgcgaacctgtcacaccgccatcaggttggggagagccgaaaactcagcaggctgcttatgcaaattcaacaacgaatgatacaaagcccgaaagtgcggtagaaaataccgatgattttaatgtttaactcatcaaagcctttcttcggaaaggctttattttttcctaatgattttgttcttggatgtatttcgctataatcgcccaccaaaatcactctaaaaattaaccgcattttatgaaactttacgcaaataataaatgtcttgatttaagcgtgcctcaaattatggggattcttaattttacgcctgattctttttctgatagcggacagttttttagtctagataaagcactttttcaagttgaaaaaatgctagaagagggggcgacaattattgatattggtggagaatccactcgtccgaatgcggatgaagtttctgaacaagaggaattgcatcgtgttgtgccagtagtggaggcggtgcgaaaccgttttgattgctggatttctgttgattcctcaaaagctgttgtgatgcgtgaagcggcaaatgttggaatggatttgattaatgatattcgtgctttgcaagagccgaatgcgttagaaacggcggtaaaactggctttacctgtttgtattatgcatatgcaagggcaacctcgcacgatgcaagcaaatccttattatgaaaatgtcgtgcaagatgtattggcttttttacaaaaacgtactaatgaatgcctttctgctggcattaaaaaagaaaatttaatttgggatatgggctttggctttggcaaatctgtacagcataattatcaattattacaaaatctgaatgaattttgtcagataggttatcccgtattagcagggttatctcgcaaatcaatgattggcgcagtgcttgataaacctgttgatcaaagaataattggcagtgcggcaggtgcgcttattgcagtgcaaaaaggtgcaaaaattttacgcgtacatgatgttgctgcaacatcagatatgctcaaagtttggcaggcaacagcaaatgcctgatggttttataacgataaaaaattaaaggaattttattatggcaaatcgtaaatattttggaacagatggtgtacgtggaaaagtaggtgcttacccaattacaccagatttcgcattaaaattaggttgggctgcgggaaaagtgttggcttctcaaggttcgaaaatggttttaattggtaaagacacccgaatttctggatacatgttggaatcagcccttgaagcaggtttggctgctgcggggttatctgctgcatttaccggccctatgccgacacctgcaattgcttatttaaccagaactttccgagctgaagcaggtatcgtgatctcagcctctcataatccttattatgataatgggattaaattcttttcagcaaaaggcactaaattacctgatgaaattgaagaagctattgaagcaatgttagagcaaccgatggattgtgtggaatctgctgaattaggtaaagccagccgtattaatgatgcagcaggacgctacattgagttttgtaaaggtacattccccgctcatttaggcttggaaggttataagatcgtggtagattgtgcaaatggtgcaacttaccatattgcccctaatgtactaagagaacttggtgcggaagttattgaaattggtacgganccaaatggtttaaacattaatgaaaaatgtggcgcaactgatgtgactgcattgcaagctaaagttgttgaaacgaaagctgatgttggtttggcttatgatggcgatggtgaccgcattatgatggtggatcatttaggaaataaagtcgatggcgaccaaattctctttattattgcgcgtgaagcattgcgctcaggtcaattaaaaggcggtgtcgttggcaccttaatgagtaatatgagcttagagattgcgttgaaaatgcttggtgttcccttcttacgtgcaaacgtgggagaccgttatgtattggaaaaaatggttgaaaatgattggacgcttgggggggagaattctggacatattatcattgcggataagaatacaacgggtgatggcattgttgcgtcattggctgtattggcggcgatggcacagcataaattatcattaaatgaattagcaagtgcggttaaattattccctcaagtgttaatcaatgtacgttttgcgggtggggaaaatccacttgaaagtgatgctgtaaaatctgttgccgcagaggttgaaaaacgtttagaaggtaaaggtcgtattttattgcgtaaatcgggtacggaaccacttattcgcgttatggtggaatgccaagatgctgaacttgcacaacaatgtgcagaagaaattgcagaagccgtgaaaaaaattaattaatttttgaccgcacttagtaaagtgcggtttatttttataaagtttttaggaaagcnaaatgaacatttttattatgcgtcacggcgaagcggaagtaatggctaatagtgataaagctcgccatttaactgtttatggttctaaacaggcttttttacaagggcagtggttaaaacagcatttaagcacgctagtaattaattcactagaccgtattttagtgagcccttatgtcagagctcaagaaacctttcatcaagttaatcaagcgtttgatttggagttagaaaataaatttgaaatttgggaggggattacgccttatggccatgcgcattcagtcattgattatttagaagtgctaaaagacgagggcgttaaatctgtattaattgtttcccatttgcccttagtgggagaaattgttgctgaactgtatggaaaacgaaatccaatatcattttatcctgcaactattgctcaattattatgggatggtaataaatcagaaatattgatgcatcaagcatctcctgtaatttatttaaaataaactattctttttttttacaaaaaataaaatttttattggttttttataatctattnaaaatcaatatcttagatgtttttttataaagtaatctttttaaagaaaggtaaagttttactattactgtttttctttttatgaaaattcccgtaaactaaactgcatcaaagtaatagggctttgtaacaatcaaattattctatggagaaaataatgaaaaaattaacattagcattggttttaggttcagctttagtcgtgacaggttgttttgataagcaagaagcaaaacaaaaagttgaggatacgaagcaaactgtagcatcagtcgcatcagaaacaaaagatgctgcagctaatacaatgactgaagtaaaggaaaaagcacagcagctttctacagacgtgaaaaataaagtagcagagaaagtggaagatgcgaaagaagtaattaaatcagcaacagaagcagcgtcagaaaaagtaggcgaaatgaaagaagcagcatcagaaaaagcaagtgaaatgaaagaggcggtttcagaaaaagcaactcaagcagtagatgcagtgaaagaagcgacaaaataataggtttaatttaaataacaaaatccctgttaaagaaatttaacagggatttttcatagattaatccaatttgatttttacaaataatatcccgccattgagctatataccgcattttcactttgcagcacttgatattttgcattcaaaatcgcaagttgtgatgatttttccgtattggctgcaactaaccattcgcgcaattcggatacgcccgcattatagcggtttcgataatattgtgtgatacgctgattgtaactatgggtttgctgtaaattacttaatgtactttgcgcttgggtaaatgcgaaatagttggtatccacattattgagagcggtggtaatacgttgttcgtaatttaaacgagctgtttcatagtcagcttcagaaattttaacgttccattttacggtgttccaatttaagaacggtaggctaattcctactgtgccagcagccacagggttatgtaacgccgtaccaaccgtgcttgctgttgaagaaaggcttgcacctaaattaacctctgggaaccaacttttttgagttgctttggcatttttgaatgcactgcttaaacggaattgtgctgcttttacatcaggacgatttgcaattacagacacaggcacgtttaagtttacgcctgctgttttcacattcataatatgtgggaacgtgatatttaatgcttcatttggttttaggttgagaagattacgcagtgtttgttctgctgttttgcgttgggtttcaaaatttaatttgttattacgtgccgttaatatggcttgttgtgcttgatccgttccccagtctggctgattggtaatgaggcagttagatttcaataaatggctgactaatttttcttcgacaatttcattcgatacgcaatctttcagccaattagcgttaaattcgtagctagtaatttcaatatcttgttcatcaatgcaatcgccttgtaaatgattaattttttgagcatcataaactgccactggatttaaccgcacttttacatcgccttgcgcacattcgcttaaatcgcgttgcatagtttgttgaacggcattgaagtcggtaaatttgctttggttgaagctatttaaataaagtttaaaactttttgactcaatcaaattttggctttgataatccagataaatatctgcgatagccacttgtggcaagcctttttcgttgagccacgagatttcataagccgtccaaatatctgcaccgatagtaaatggttggttttgagtaatgcctaatccatcacgatttaacgcacgtggcacaggctgtaataaagtgcggtcatattgagaggcatattccgttttttgaccgagttttaaggattttaagctgttgtcttggtaattcatttatttttcctttatatgttaaacaataattttgccttcccttgcttgcgggggaaggtggcgcgaagcgtcggaagggggctaagactttatcattccaacagagagttgaggcatggacttaaattacaaaaaattccacgatagattcgaaactaatcgacaggtatcgcatttaaaatgaaaggtatcaaaaatcgcgtcttttaacgcccaatttgcaccacaagaagggcagcaacgggatttttcagattctaaagattgcccacctacacgatataaataatagtaagtcggtatgccagtttctttttctatttcttgagctaaatatcgtccgtgttttgaaagcgtactttgatgatcggaaatttctgccaaagattgttgttctaataccgcaccattcatttgtagttgatcgcaggcttgccaattttcttgccatttaatcagatcttggcttaggtgcggttgattttttagttgtttatacaaagggatgggtgcgaaattttctccactatgaatcggcgagcaactttgtaaatgggttgtgtaaagcacttgccaagctggcgatgtattttcagccgtttgatctgaattgaaatcatcgcccacaagttgaaaaccatcaaaaattacgccgcactttgacggattcagccaaggatatagcgtgctgttctgctgcggtaaaatcccatttttgtagccaatccagcacagcattaaagcctataaccccagcaatattgggtgtgccagcttctaaacgataaggcaattcggcaaaagtaatacgattatttgacacacgttcaaccatttttccgccaaaaaagagcggttgaagttgagaaagtgcggtcaattttcctgttaaaacgccaagtccatttgggccataaattttatgggcagaaaatgcgaggaaatcggcatctaaatcttgtaaatcaattttaatatgactaatcgcttgtgctgcatccactaaaaccaacgcatgactatgttttctaataagttgaatcaggcgtttaatcggctgttctgtgccagtgacatttgaaacaaaattcagcgcaacgagttttgttttttcagaaagggtagaaataagcacattttcatcaattagccaattatctaaaatcggtaaaactcgaatttttgcaccgcactttttcgccgtttcatgccaagtgacaaaattagcaacttgatgaaccaaccacttggatgtggaagctattgaatggttggaaaatttcttactggatttccaaggtagcattgtatttatttcccatgaccgttctgttattcgcaaaatggcaacacgcattgtggatttagatcgcggtcaattgcagtcttatctaggcaattacgatttatatttaaccacgaaagaagaaaatctacgcgttgaagccttgcagaatgaattatttgataaacgtcttgcacaggaagatgtatggattcgccaaggtatcaaggctcgccgtacaagaaatgaagggcgagtgcgagcattaaaagcgatgcgtgaggaacgccgccaacgccgtgaggtaatgggaacagccaaattacagttagatacctcaagtcgttctggcaaaattgtctttgaaatggaagatgtgagctatgaaatcgcaggaaaaaccttgttaaaagatttttcaacaacgattttacgtggagacaaaattgcgcttgttgggccaaatggctgtgggaaaaccacgttcattaaattattgctgggggaaattcagccaacatcaggcaaaatccgttgtggtactaaattagagattgcttattttgaccaataccgtgctgatttagatcctgaaaaaattgtaatggataatgtggcagatggtaaacaagatattgaaatcaatggtgtaaaacgccatgtactagggtatttgcaagagttcttgttcccaccaaaacgagcaatgaccccagttaaagccttatcggggggagaacgaaatcgtttattgctcgcaaaattgttgctcaaaccaaataatttattgattcttgacgaaccaaccaatgaccttgatgtagaaacattggagcttttagaggaaattttgactgattatcaaggcacattgttaattgtgagccatgaccgtcaatttatcgataatactgcgacagaatgttatttattcgaaggtgaagggcgtttgaataagtatgtgggtggattctttgatgcgaaacagcaacaagccaatttctgggcaagcaaagcggtggaagaacaggctaaggcgaagaaatctgaaccactaaaagaagaaagtgcggtgaaaaatgaccgcacttctaagccgaaatccgtgaaactttcttataaagaacaacgagagctagagcaacttccacaacttttggaagaattagaaactaaaatcaccacacttcaagctgaaatagccgatccagcatttttccaacaagctcacgatattaccgacgctaaattaaaagcattggcggatactgaagccgaattagaaacagcatttttacgctgggaagaattagaagaaaagaaaaatttggctgacggtaaagcttaaaaaataacgcccgaaagggcgtttttatttagaggaaatattgcacagaatcatattttaattctttgctaattgaccaattattttgctgcttttaattcttgataatattgttcatagaattgaattgcatcgccaacgtcatcttgccagtgactattttttaatatatcagctgacggataaatcgctggatcttcagtgatttcttttggtaatgcttttttcgcttcaatatttgaggttgggtaaccgatagctaaggttaatttttcagctgtttttttccctaacatgtagttaatcagcttgtgtgcgccttcagaatttttagctgttgcaggaattgcaagagtatcaacccaaagtacaggaccctcttttgggaataccatatttaaaggtgctttttcttttttagcaatacgtaccgaaccattccataattgacccacttccacttcgcctgagatgaacgagttagctgggttatcggaattgaaagaaagtacatttggacgtaatttcaataattcttcataggcttgtttgataatggctggatcttgagtatttggatcttgaccaattttcaataaagcgatgttgaatacttcacgcgcatcgtctaataattgaactttgtttgcaaattcaggtttccataagtctgcccaagaagtgaattgttcgcctttgtaagtgttggtattgaatgcgatacccggcgcacctaaaagttgcggaagagagtatttgttacctttatcataaggtttattgagccaatcaggatctaattctttaagaacaggtaatttgctgtgatcaagttcttttaacattccttcgcgtgccattttagaaacgaagtagttagaaggtgcgataacatcatagccaccagactcgccttgagttttgagtttagcgtacattgtttcgtttgattctaggcttgaaacgataactttgatgccagtttctttagtaaactcatctaaaagaccatctggtacatattctgtccaagtgtagagatacacagtgtcattagcagcagccgtagcttttgcagtttcttgcttagcatctttatcgttgcaagcggttaaagttgcagctacgaagctggcagtaattaaacctgcaaattttttcatttttgtttgttctcctgttaaagagtcgtaaaaaaccacctgccgaatgacaggcataaaaaaacgccttgattgtgcgtcaaggcgtattctattttaaattcaaaggtttgtgaaaccttttgttaattaatggttattttttcgtgtaattagctggcttaaaacgacaagagctaatgaaagcacgatcataatcgttgctaaagcattaacttcaggtgttacaccagttttcactagagagaatattctcaatggtaagatttcataacttacaccactgacaaatgatgaaaccacaacatcatctaatgaaatagtgaaacttaataaccaaccagatacaactgcaggtaatgctaaaggaaggataattttacgtaaaatagtcacttcgcttgcacctaagtctttcgccgcttctaacattctggaatcaaagccatttaagcgagagaagatagttacggtcacatacggtaaacagaaagttacgtgggcaagtagtaaagaccagaagcccaatgaaatacccacaaccataaataatgcaagtaaagatactgccattacaatatctggagacatcataacgataaatagcataccgcttactgcttgtttaccgcggaatcgatagcgataaagtgcgattgcagttaatccacctacaatagtagctagggtagccgcaaaaaatgcaatagttaccgaatgaatcgcagcttgtattaaggtgtcgttattaaataaacgctcgtaccagttccagctaaaacctttccaactcaaaccataacgatctttgttaaaggaattagtgactaaaataataattgggatatacaaataagcgtataccacaaacataaatgcattacgtagaaacgactcattattctaactccactttcctattcaatagtttattcgcgcggtagtacacgaaaatcaacaatgccattagaacagttaaaccaatactgactgcagaaccaaatggccagttacgagaaattaagaattcgctcttaattacgttaccaacaagcaagacttttgctccaccgagtaggtctgctacataaaacattcccattgctggcaataataccaataaacaacccgcgataatgcctggcatagttaatggtaaaatcactcggaagaaacgttggaatgtatttgcgcctaaatctcgtgctgcttctaataaacgattatctagtttttcaatggcagagtagagtggcaaaatcataaatggcaatagtaaataaactaagccaatgattaccgcaatttcggtattcaaaatacgaattggcgcactcaaaattcccatatcaattaacatcgtgttaagtatgcctttcacgccaagaaataccttcattccataaatacgaattaacgagtttgtccaaaatggtaaaaccacaaggaacaataagagcggtcgatatttaggatgaattttactcatcataaaagcaaatggataacctattagtaagcaaataatggtggcgatgcccgacatagacaatgaattccacacaacttgtgcataaagcggattaaacaagtttgtatagttttcaatagtaattgggaatgcataaaagttgctaccatctcgagtcagaaaacttacggcaagtaccaataagtttggaatcagcacaaagaagattagccaactgaagataatcgcaacagtaattttctggaatttattattgattatcttcatcgttgagtacaacctcccagccttcgtgccatgtgatacctacgcgttgtcctatgctatgatccatatgtggatcatcttcattaaagaattcacttacaaggacacgcattccgttatgatcaaactctaccgttgattctaatgtcattcctttataagtgcggtcaataatatgaccgataattgctttagaatgttcattttcatctaattcttcaatcacaatatcttcagggcgaaggagtacttgaagtttttgatctttttccacaggcatatccgtataaatatcacaaatacgaccttcaacatttgccagtacaacttgttctgattttcgttcaatcacagtggcttcaaatacgttaatttcgccaatgaaacgagcaacgaataagttagctggatcttcatagatttcacgtggagaaccatcctgtgcgattttacctttacgcaataatacaatacgatcagacattgtaatcgcttcttcttgatcgtgggtgacgaaaataaaggtaatgccaagctgacgttgtaacattttgagttcttgctgcatttgtttacgcaatttgtaatccaatgcagataaagactcatcaagtaacaacacttttggtttatttactacggcacgagcgatggcaatacgttgttgttgtccgccagaaagttgagttggcttacgatccgccatttcttctagctgtaccatacgcaaggcttctaaaacacgcggtttaatttcctcgtttggtactttttgcatacgcaaaccgaaagccacgttctcaaaaattgtcatatgtggaaatagcgcatagctttggaataccgtattaatatgacgtttttccgctggcacattggtgatatcttcaccatctaaaataatgctacctgaatccaattcttctaagcctgcaagtaagcgtaaaactgtggtcttaccacagcctgaggggccaagaatagtgacaaactcaccgttattaattgtaagattgaaatcattaataatggtgttagaaccataggattttttgattgaacgaagctcaataataggcttgttttgaagctgattttccactagctttggttttctccctaatttcaccaatgatttggtactgagtagaaataaaacctgcaagactgcaggggcgacatataaaaatagacgcctatgatatagtgaattgttaataatgaaaaggacttaatgccttagaaagtaaaaaactgccgttcataaaaataacgagaaatttaaccgcactttcgatgaattttacttcgttaattttataaatattgttatatatcaagatgttttctatttttctcgttaaactaaaaaagatatttttaaaaggagcgagaatatgatttctcaaatagataaaacagaacttttagaacgatttttacattatgtgtcttttcacacccaatcaaaacctaatgcgaagcattcccccagctcagtcgggcaaatgaagttagccatgcagttacaaaaagaattaatccaacttggtttggagaatgttgaagtaagtaaatatgcagtggtaacagcatttttacccgctaatgatcctaacttaacgaaaaccattggtttagttgcgcatcttgatacgtctccacaatgtagtggtaaaaatgtacgcccagaagtgatagaagaatatcgtggcggagatattgcattaggtattggcgaggaatttattagccctgtttattattcttttatgcaaaaattagtcggacaaacgcttattgttactgatggaaccactttgcttggggctgacaataaagcgggaattgcagaaattatgaccgcactttccattcttcaaaaagagaatattccccattgcaatattcgtgttgcttttacgcctgatgaagaaattggtttgggaatccattatttcccaatggaaaagttttcctgtgattgggcatataccattgatgggggagaagtaggggaattagaatacgaaaactttaatgctgcaacagcaaaagtgcggtttttcgggcgaaatattcacacaggttatgcaaaaggaaaaatgctgaatgcactgactttagcttgtgaatttcagcaagtttttcctgttgatgaagtaccagaaaaaaccgatgggaaagtgggcttttatcatttagaagatttttctggcgatattgagcaagtagagcttacctatttgattcgtgattttgacgaacagaatttcgcacaaagaaaagcttttattaaaaatcaggtggaaaaatttaatgctaaaaaaggtttgaaaaagcctatagagttagaaattcaagatagctaccaaaatatgtatgatgtggtaaaaaacgttcctcaatcaattgaacttgctgatcgtgcaatgaaagcggtgggaattaaaccaaatcataagccgattcgaggcggtacagatggagcatttttagcctctaaaggtttagcatgcccaaatatttttactggcggctataatttccatagtaaacacgagttggtttctttacaaggcatggaaaatactgtccaagtaattatcgaaatgctgaaatgtaaagatttgtaaagaaatgtaaagatttttcttgctattctttagattgctcaatataatggtggcgttttatcgagatttctttgatgaagctaaactttagagattttattcataaattcctttttaatgcccctaattatttaggggccttttttatctaattggacaagaaataataaaatagctaacaaatttaatatttcttcattttaaattattttttatcctattaatttaattctaaattctcaagaatatattttatcaactaaaaaatagttaataatcacaatttttaacgcgctacaatatttatttctatagatttatttactgatttaaaaaaacgttaaatttagtggctaaattagtttaaagagatcactgtaaataataggtataagagtttccttatattcagactgaatttgacattcctattctaaataggaaactcttacttttgaggtaatttgttagatcaaatttgatcttagacaaattaaattaatctaactttattgagttagattaattgcaggttagttttcgttagcgttgaaatttattcattaattatggcaagtttggcaagctgcttggaacatccatactaatttttcttgttctttaatatagtcactcatttgtgatgcagtaccttcatcattagcgttatttgcaaaagcaagaatttcacgttgttgatctagtaatgtttttagaccttgtaatgtgcctgataaacattcttgtgcctcacttactgcaatatcttctttaattcgagatatttttaagtattggctgtaagcattatttggtgtgtaacctaaagttaaaatacgttcagccacctcatctactctagcaactaaattagtataaatttcttcaaattttgcgtgtaatgcaaagaagtttacgcctttaatgttccagtggtagccccgtacattagtatagaaaacttggtaggttgcaagtaattcgttaagtttatcggctaattctgctgattgaactttatctagtccgattgatgtttttgacataataatttcctttttctagttgaataattgagctaatgccctccctttgatatgggtattatacgtttctataatttgaagtgaaattgttctattcaatataattgatagtcttagccttgtttgttaagaaattgtaataaatagaagctatcaaataagtgatcaagatcacagttttaatgaatatttaatcaaactatcgcggctaacaataaattttgatttaataagtacagttataattttnaatatttttcctaaggatatgttatgcaagaccttattaagcgcacctngccacaagatgatgcacttaatcaagctattgtgaatgancttcgttcacaaaattgggctggttttttaaattattcccaagtgcagcagctttgtcataattttgaacttaccacactaaaattggctatgcacttgtngccacttgctgcaagttatagtcatactgctatttctcattttaatgtgggggcaattgctattggcgaacaaggggattttnatttcggcgcgaatcaagaatttgctaattcagccattcagcaaacgattcacgcggaacaaagtgcaatttctcacgcttggttgcgtaatgaacgccgtatttcagatatggtggtcaattacacgccgtgcggacattgtcgtcaatttatgaatganttgcacggtgctgaaaaaatttcaattcatttgccgcatagccaaaataatccattacattcttatttaccggatgcgtttggaccaaaagatctcgatattgcagcgcatcttttggcggaagaaaatcatgatttagttgctgatcatcaagatgatttggttaatcaagctattttagcggcaaatcaatctcattgtccttattcaaatagcccgcacggcattgcgattttatttaaaaatagcgatgtggtgacaggacgttatgcagaaaacgccgcatttaatccaagtttgccagcgttgcaaaccgcacttaattttgcgtatttaaatgataaaaaattgagtgatattgagcgaattgtgatggctgaaaaagcattaaaattgagccataaaacgatggctgaaaccttattatccacattaacttcggtagaattagagtattattctttgtaaatatgaaacgcgagtaaaataaaaaggaaataatttccttttttatttatttgctaaaattaccgctcttttcggtgcttgataaccttcaatggttttactgtgatcatttggatctaaaaaatcaatcaggctttcattttccaaccaatcagttttacgctgttcttctaatgtagttgtcgctacatcaacacaacgtacgttggtaaagccaactttttctagccagttaattagtgtggcgacagaggggataaaataaacatttttcattttcgcatagcgatctgctggtacgagcacagtatttatatcgccatccactactaacgtttctaataccaattcgccaccttttaccaattgatttttcaactggcttaaatgatctaatggggatttacgatgatagagtacgcccattgaaaatacagtgtcaaatgccgctaatggttgcatttgctcaatacctagcgggataagatttgctcgacgatcattattaagcagtttgcgtacggcttcaaattggcaaaggaaaagctcggtaggatcaatcccgaccaccatttttgcgccttcgcctaccattctccacatatgataaccgctgccacagcccacatctaaaatagtgcgaccttgcaagggcgacaagtgaggaagaacacgatcccatttaaaatctgaacgccattcacaatctacatgaatgccgaaaagatgataaggcccttttcgccacggcattaattgttttaaatgatggataattcgttgtttttcaccttctgaaaggggagaagtgcggtcagatttcaccgcacttttgagatcgatttcatcagcatgcaaattaggtagaaaatcaacaattttgctccatttcgcataatcgccatgagtttgagtttcccattctttcaattggcacggtaaggtctctaaccagtctgataaatttgtagtagcaatttgttgataaaaagggcgaaagtcgatcattttgcttccttataagccttttctgctttatcaaaggtattaagaatatcttgttctggtttattggaaagtaatgaaataacaataattgcaaggctggcgaaagcaaagcctgggatcatttcatatactttaaaccaatcagtatcagctggaacaacttctttccaagcaaatactgtcactgcacctacaagcatacccgccattgcacccgatgatgtcattcgtttccagaaaagagagaaaagtacaacagggccaaatgcactaccaaaccccgcccaagcaaattctacaagttttaatactttgctgttttcatcttgtgcgatccagatagcaagtgcggcaataactaacaccataattctgccaagccatacgagctctttttcagatgcgttagggcgaataaaacctttatagaaatcttctgtgattgagctagaggaaattaacaattgcgcacttaatgtactcattactgctgctaaaatagcggaaagtaatatgcctgcgatccaaggattaaataaaagtttagctaattcaataaaaacctgttctggttcgcgattaactgtgcctgcaatagctggatttgcaaagaaatacggaatagcgaataagccaatgccaattgcgcctgctaagcaaagcaccatccaacccatactaatacggcgtgctttgataagtgatttgacagaatccgcagccataaagcgtgctaaaatatgcggttgcccgaaatagcctaatccccaagccgcaagacttaataaaccaagtggtgtggtagaagtaaataaatccgtgaaatctttatttacggcagcctcagcttgttctagtactgcggaaaattgagcggtatcggcgaaactcaataacacaaaaacaggggttaaaattaatgcaaaaatcattaatgtggcttgaatggtatctgtccagcttaccgcaaggaaacctccgatgaacgtgtaagcaatggttgccgctgcgccgtaccaaagtgcggtggaatattccacagaaaatatattttggaataattttgcgccagccacgacaccagaagcacaataaatagttaaaaacactwaaataatagtggcagaaacaagttttaataatttgtgtgatgaaccaaaacgattgtgaaaatattctgggagagtgagcgcattattatttaattctgtataaacacgcaaacgaccagccactaaaagccagttaaaataagccccgatagttaaaccaatagcaatccagccttcaactaagcctgataaatataccgcaccaggtaagcccattaaaagccaaccagacatatctgacgcacctgcagacattgcagtaacaaaactgcctaaacgacgtccaccgagaatgtaatctgataaattattcgtgtaataataggcgagtacgccaatcagcaacatcccgaaaatataaatagtaaaagtaataagacttgggtcgaatccaaacattatataagtccaaaatgggttaaaaatttcagaaagggtgcattttaccttatttcgggctattattctatttagactaaatatttgatgaaatttaagaaattaggaatataaaatggatgctgtcgagttattgatgaacgtaacgcctaacgaaacacgcattgcgctagtagaaacaggaatgttgcgcgaagtgcatattgaacgccaagctaaacgaggaattgtcggaaacatttataaaggtcgtgtcactcgagtgttaccaggaatgcagtcggcttttgttgatattggtttggaaaaagcggcttttttacacgctgcggacattgtatcccatacagaatgtgtagatgaaaatgaacaaaagcaatttaaagttaagagcatttcagaattagtacgagaagggcaggatattgttgtacaagtggtgaaagagccgctaggtacaaaaggtgcacgtttaacaacggatatcacattgccatcgcgtcatcttgtttttatgcctgaaaatagccacgtaggcgtttcacaacgcattgaaagcgaagaagaacgcgcccgtttaaaagcattagttgaacctttttgtgatgaactcggcggttttattattcgtaccgccacagaaggggcaagcgaagaagaattacgtcaagacgctgaatttttaaaacgcttatggcgtaaagttttagaacgtaaatctaagtacccaaccaaatcaaaaatttacggcgagccagcacttccacaacgtattttgcgcgattttatcggcacaaacttagaaaaaattcgtatcgactctaaactttgctttggcgaagtaaaagagtttaccgatgaatttatgcctgaattaagcgataaacttgttctttattctggcaatcaacctatctttgatgtgtacggggttgaaaatgcgatccaaacagccttagataaacgtgttaatctcaaatcgggcggctatttaattatcgagcaaacagaagccatgaccaccattgatattaatacaggcgcatttgtggggcatcgtaatctagaagaaaccatcttcaataccaatattgaagcaactaaagccattgcgcacgaactccaactacgtaatcttggtggcataatcattattgattttattgatatgcaaacagatgaacatcgcaatcgagtattgcaatctttatgtgatgcgctttctaaagatcgtatgaaaactaatgtgaatggctttacgcaattaggccttgtagaaatgactcgtaaaagaacccgcgaaagccttgaacacgtgctatgcgatgaatgtccaacttgtcatggacgtggtcgggtgaaaactgttgagacagtttgctacgaaattatgcgtgaaattattcgggtgtatcatttattcagtagtgaacaatttgttgtttatgcctcgccagcagtttcagaatatcttattaatgaagaatctcacggtttactgccagaagtggaaatgtttattggaaaacgagtaaaagtaaaaacagaacagttttataaccaagaacagtttgatgtggttgtaatgtaaactctatttcaataaagtgcggtaaaaatttttgagactttcaccgcactttttatttataaaaacaatatttcctttatattttatctatatgacgtaaaattaggcagctttagttgatacgcctccctccactacatcacattaaaaagcggtatcgccgtgaatgcaggcaaaaacagcaaaatttcctatcaaatgggagctggctgggtttggtaagctaaacattcaaaaaacttaccgcactttgtgcatttatacatcgccacgataatttcgtggcggttttttatggcaagtttttacaatcttttatttaaatctagtatttctatggcaagaacaggagatgaacctttattttcccttagatttgtatagaatagccgaatatttttttattttaacgagagaaaatgatgagccatacagagacatctttgggtgcagaaaatacccgcactcataattttattacccaaattattgatgaagatttagcttcgggtaaacataaaagcgttcatacccgttttccgccagagccgaatggttatttgcatattggtcacgcaaagtctatttgcttgaattttggcttggcaaaagaataccaaggtttatgtaacctacgttttgacgataccaatccagtaaaagaagacgtggaatatgtagattctatcaaagcggatgtggaatggttaggttttaaatgggagggcgaaccgcgttatgcatctgattacttcgatgcgctttatggctatgccgttgaattaattaaaaaaggtttggcttatgttgatgagctttctccagatgaaatgcgtgaatatcgtggtaccttaaccgaacctggtaaaaacagcccatatcgtgaccgcactattgaagaaaacttagcgttatttgaaaaaatgaaaaatggcgaatttgccgagggtaaagcaagtttacgtgcaaaaattgatassttcgccatttatggtcatgcgtgaaccagtaatttatcgtattaaattctctagccatcaccaaacaggtgacaaatggtgtatttacccaatgtacgatttcacgcactgtatctctgatgcgattgagcgtattacacactcaatctgtacattagaattccaagataaccgtcgtttatatgactgggtgttggaaaatatcagtattgaacgtccattaccgcatcaatatgaattctcacgtttgaatttagaaggcactttaacctctaaacgtaaattattgaaattggtaaatgatgaaatcgtggatggttggaacgatccacgtatgccaaccatttcaggtttacgccgtcgtggttatacaccagcttcgttacgtgaattttgtcgtcgtatcggtgtgactaaacaagataacgtcgtagagtattcagcacttgaagcctgcattcgtgaggatttaaatgaaaatgcaccacgcgcaatggcagtgattgatcctgttcgtgtggtaattgaaaattttgaaagcgaagcggttttaactgccccaaatcatccaaatcgtcctgaattaggggaacgtcaattgccgttcacgaaagaactttatattgatcgagctgacttccgtgaagaagcgaacaaacaatataaacgcttagtattaggcaaagaagtgcgtttgcgtaatgcttatgtgattaaagctgaacgtgtagaaaaagatgcaaatggtgaaatcaccacgatcttctgtacttacgatcctgaaactttaggtnaaaatccagcagatggacgtaaagtgaaaggtgtcattcattgggtttctgcggttaataatcatccagctgaattccgtttgtatgatcgcttatttactgtgccaaatccaggggctgaagatgatatcgaaagcgtgttaaacccaaattctttagtgataaaacaaggttttgtagagcaaagcctcgcaaatgcagaagcagagaaaggctaccaatttgaacgtgagggttatttctgtgcagatagtaaagatagccgacctgaacatttggtatttaacttaacagtaagcttaaaagaaggcttctaattttaatcaaccaagtgcggtcaaaacaaacgtgattttgaccgcactttttatttgtatcaactatgcaatccaatatgcaacttgaacccaatttctggcaaaccaaatccctgctagaaatgactgaatctgaatgggaagccttatgtgatggctgcggcaaatgctgttatcgcaaatatattcaagggcgaggtaaacgccaaaaactctattacacccgaattgcttgtaatcttttagatctggaaacaggaaagtgcggtaattattcagagcgttttaacattgaaaccgattgcaccaaactcaccaaaaagaatttacctgattttcattggctgcctgatacttgtgcctatcgtttgctttatgaaggaaaaacgctacccgaatggcatccgcttatttctggctctccccattctgtaaaaaatgcggatattttgattaaaaatggtatccacgaacgagatgtgattgattggtttgagtttattattgacgaagatcacacttttaaataaagccagttgtcatcactttcagcttagctataatccctaacaagagttatacagttgtgatgtggtgtctatgcaaatctcggattctctcaaacaaaaagcagaaaaatgcggtatcgcgctttctcactatgatattgatggacatcttattttcgcggatgaaaagacggtttcaacttttgttgagcttttgcagcctccgccaaaagcgaaaggacagtttgacgatgtactggctgcatttgaaaatgaaccgattgattatcgactcaatcgtctagatttgccaccatctgcggaatatcgttatcagctgactgatgaatctaatgctattctgttagaaaaaatactttcaaatttatccgtactttctttgcctccacttccttttggctattatcaattatctattttttccgatactgaacagtaccgaattcgtttacttatttctcctaaaacagcttttcaaccacccgtattagaaaataaaaaagtgtggggcgtaaatgtgcaactttacagtttacgctcagaacaaaactgggggattggcgattttggcgatttagcctatttgattgaacaaagtgcaaaacaaggggcggattatgtgggaattaatccattacatttgccatatcctgcggtgccaaactgggctagcccttatagttcatcctctcgtcgttggttgaatttcttatatttggacattcctgatttacccgaatttaagcgttgccgttcagtacaaaattggtttaagcgtgaggatattcaagcaaaaattgctgctttacgtgaaagtgattgcgtcgattattcttcaattttggctttaaaattaaccgcacttgagcccctgtttgatttctttcagcgtagtcaatccgttgaaattgtgacacgtcgaaaaatctttgctgagtatttaaaaaacaaaggtgaacctttgttgttacagggtttatttaatgtcttggatttgcaagaacacgccgatcatcaagcagaagaaaataccataggttggcttggctggcgtaaggaatggcaacatttaagtgcggcaaaaagaaaagctctattaaaaacacaccatgagaaaatccaattttttgcttggttgcaatggcttacagaagaacaactttccgcattacaaaatctttgtaaacagtctggcatgaagttgggtatttatggcgatttagccgtaaatagttctcgtggcagtgctgatgtatggagcgatcctgatttatattgtgtaaatgcctctattggtgcgccgcccgatccgttaggccctgtaggacaaaattggaatttgccaccttataatccaacagtgctaaaagcacgtggctttgcaccatttatcgatatgctatgtgccaatatgcaatatttcggtgtgctacgcatcgatcatgttatgggcttatttcgtttgtggtggattccaaaaggaaaaaccgcggctgacggtgcttatgtgcattatccttttgatgaattaatggcgantcttgccattgaaagtgttcgcaatgaatgtttgattatcggtgaagatctcggcactgtgcctgatgaagtgcggtggaaattaaacgagtttcaaattttctcttattttgtgttgtattttgcccaacgaaatggcgaatttccccgtatatctgattatcctcgaaatgcttatgccactattggtacacatgatgttccctcattacaaagtttttggcattgtcgtgatttagaattatttaatcaactcggtattctgaatggggaagtgctcaagcaaaaatatgatcaacgtgtcatggataaacaagccttattaaatagtttacatcgtgataattatttaccgccgcattatgagggcgatgcgctttctatggcgatgcacgattatttaaatcgaatgatccattattatttagcggaaagtaacagccgattgattggtgtgcaattagaaaatttacttagccaagaaatcagttttaatttaccgagcacctcaaatgaatacccaaactggtgcaagaaacttgctcaaccgttagcgtttatttttagcaatgaagctttaaaaacgttctttgtgcaaattaaccaagggcgaaatgtataaggagtaaatatgacaaccgcagtaacacaagcaattattgatggtttttttgatgcgagcaatggtgatccttttgctacgcttggtatgcacgaaaccgagcaaggaattgaaatccgtacgttattgccagatgccaatcgaatggtggtgattgagcgtgaaagtggtaaagaaataacggaactggattgtgtcgatgagcgtggattttttgttggtgttattccaaattgtcgtcaattttttgcttatcaattacaggttttttggggtaatgaagcacaaattatcgaagatccttatcgttttcatccaatgattgacgatttagaacaatggctactttctgaaggatctatgcttcgcccatatgaagtgcttggtgcgcattttatggaatgtgatggtgtgagcggggtgaatttccgcttgtgggcacctaatgcaagacgagtttctattgtaggtgatttcaactattgggatggtcgtcgccacccgatgcgtttccactcgaaaagtggtgtttgggagctctttttaccaaaagccagtttaggacagctctataagtttgaattaattgattgccatggcaatcttcgtttgaaggccgatccatttgcctttagttcgcaacttcgccctgatacagcttcgcaagtcagtgccttgccaaatgtagtggaaatgactgaagcacgcaaaaaagcaaaccaaggcaaccaaccaatttctatttatgaagtgcatttaggatcttggcgtcgtaatttagaaaacaatttttggctagattacgatcaaattgctgatgaattaattccttatgtaaaagagatgggctttacccatatagaatttttaccgctttctgaatttccgtttgatggttcttggggttatcaaccacttgggctttattcgccaaccagtcgctttggttcacctgaagccttccgccgtttagtaaaacgtgctcacgaagcaggcatcaacgtgattttagattgggtgccagggcatttcccaagtgatacgcatggtttagtcgcatttgatggcacagctttgtatgagcatgaagaccctcgcgaaggctatcatcaagattggaataccttgatttataactatgggcgtaatgaggtcaaaaatttcttatccagtaatgcactgtattggcttgaacgttttggcgtagatggtattcgcgtggatgctgtggcttccatgatttaccgtgattatagccgtgcggagggcgagtggattccaaaccaatacggcggacgtgaaaatttagaagccattgagtttttaaaacacaccaactggaaaattcacagcgaaatggcgggagcaatttctattgcggaggaatctacctcttttgcaggcgtaacccacccaagcgaaaacggcggcttgggcttcaatttcaaatggaatatgggctggatgaacgatacactggcttatatgaagcttgaccccatttaccgccaatatcatcacaacaaaatgacctttggaatggtgtatcaatatagcgaaaattttgtgctaccactttctcacgatgaagtggttcacggtaaatattcacttcttggcaagatgccaggtgatacgtggcaaaaattcgctaacttgcgtgcatattacggttatatgtggggctacccaggcaaaaaattactctttatggggaatgaatttgctcaaggcagagaatggaattacgaagaaagtttggactggttcttgcttgatgaaaatattggcggaggctggcataaaggcgtattgaagctggttaaagacctcaatcaaatttatcaaaaaaatcgaccgctctttgagctcgacaactccccagagggtttcgattggcttgtcgttgatgatgcggcaaattctgtgctcgcctttgaacgtcgcagttcaaacggagaacgtattattgtcgtcagtaactttacccctgtgcctcgccacaattaccgcatcggcgtgaatgttgcaggaaaatacgaagaaattttaaataccgattcgatgtattacgaaggttcaaacgtgggcaattttggttgtgtcgcaagtgaacaaatcgaaagccacggacgagraaattcgatttcagtgtccattccgccgttagcaacagtttatttgagattgaagacgaaataatccgaatagataaattgtaggggcgaattacattcgcctgataaaccaccgatgtttttgggcaaatgtaatttgcctacaaaatcgataaaaatatgttcaaaatctacaacaacggcaatcctattccaatgggatactcacaagcggtcgaaaacaacgtgcaaattaccaatttcgccctgttttccgctgcggcaataggcgtagaactttgcctttttgacgaacaaaatcaagaaacacgcttgccgatggtgcgtactgaaaatgtgtggcatttggcggtaactggcgtgaaaactggtacggaatatgcttttcgtattcacggcgaatttgccaatccgcagaaattgatactcgatccctatgcgaaagccgtgaatggtaaacctgatttaagtagcgaagaaagtcgttcttggttcttgctttcggataatcgcgacaacgcgcatcttgccccaagagcggttgtaatttcagaggaatttgattgggaaaatgacacttcacccaatacgccttgggctgaaaccattgtgtatgaattacatgttaaagggtttagccagttaaacgagaaaatccctgcggcgttgcgtggtacttatactggattagcacatcctgtgaatttggcgtatttgaaagaattaggcgtaactgcggtggagttgctgcctgtaaatttccatataaatgaaccgcacttacaggcacgaggcttacaaaattattggggatacaatcccttagcgatgtttgcggtagaacctaaatatgcggcaacaaataatccattggctgaatttaaaacgatggtaaaggcatttcacaaagcaggcattgaagttattttagacgtggtatttaaccattccgcagaatcagagcaaacttacccaacattcagccagcgtggtattgatgatcaaacttactattggcgcaacgatcaagggcgttatatcaattggacaggctgcggcaatatgctcaatttatcctctgatgtagggcgaaaatgggtggtggattgcctgcgttattgggtggagcaatgccatattgatggattccgttttgatttagccactgttttagggcgtgatacacctgatttcaactcgtcagctcagctttttactgacataaaaaatgagccaagtttacaaaatattaaattgattgccgagccgtgggatattggacattacggttatcaagtcggcaatttcccaagttattttgccgaatggaacgaccgattccgtgatgatctctgccgtttctggctatggaaaagtggcgaaattggtgcatttgcagaacgttttgcaggttctagcgatttatttaagaaaaatgaccgcttgccacatactacacttaattttattaccgctcacgatggttttacgcttaaagatttagtgagttataaccaaaaacataacgaaacgaatggcgaagaaaatcgtgatggtcgcaatgaaaattacagttataaccatggagtagaaggttctacagaatccctttctgaaccgcaaaaaagtgcggtggaaaataaccgcacttttgcacaaagtggattattaatgagtttattgctggcgaatggtacacctatgttgttagctggcgatgagttcggcaacactcaatatggtaacaataatgcttattgccaagataacgagattacttggctgaaatgggcaaattttaacgaagaattatttgaactgaccaaacaaacgattgcacttcgtaagcaaattggcagtttaaataaagatcaatggtggtcggatgagaatgtgcaatggcttaacattgtaggcgaaccgatgacagttgaagattggcaaaatcaacaaaccaaagcattacaggtggttttagacaatcgttggcttttgttgattaatgccaaagccgaaggtcaaatgtttcacttgcctaataggaaatggaagccccaaatcggcacacataatgtaacccttgaagcacaacaagccgaacttagttcaatgggcttttgtatgctgaatgacgaataacaataagactatggagatccttatgaaatctggcgaccttaacaaatatgatttagttaaaaacgctttggtacttgttctcgcaggtggacgtggttcacgtttacacgaattgacagataaacgtgcaaaaccagcgctttattttggtggtaatcgtcgcattattgattttgcactttctaattgtattaattcagatttaaaccgaattggggtcgtgactcaatatgcggcacactccttgcttcttcatttgcaaacaggctggtctttcttaccgcaagagcgtggcgaatttgtcgatatgttgccagctcgtcagcaaattgacgattctacttggtatcgtggcacggcggatgcggtatatcaaaatatggctattattaaaaatcactatcgcccgaaatatattttgatcttagcgggcgaccatatttacaaacaagattacagcgtgatgttaatggatcacgtcaatagtggggcaaaatgtactgttggttgcattgaagtgccccgttctgaagcacacgaatttggcgtaatggctgtaaacgaaaacttgaaagtaaaagctttcgtggaaaaaccaaaagatccgccagcaatggtgggtaaacctgatgtttcgcttgcctcaatggggatttatgtatttgatgcggattatctttataaaatgcttgagcaggaagttaataccccgcaaactagccatgatttcggtaaagatgtattgccaaaatgtttagaagaaggtgcgctttatgctcacccatttagccgttcttgcatgggacgcaacaccgagggcgaaatttactggcgtgatgtagggacacttgatagcttctggcaatctaatatcgacttagtctctgaaaatccacaattagatatttacgaccaaagctggccaattcgtggtaatcctattcaggcttatccatcaaaatttttctacaaacactctaatgtgcaccctgtagataactcacttatcggcggcggttgtgtgattaccgatgcgtcgatcagcaattctgtattattcgaccacattaaaattgatgcattttcaaaagtggatcactgcgtggtgctaccacaagttaaaatcggtaaaaattgcgtgttgaaaaattgtattatcgaccgcgaatgtgaaattcctgatggtatgcaaattggtgtagatatggaagaagataaaaaacgcttccgtattagctctacaggtaaagtgattcttgtgacctcgaaaatgttaaagatacttgagggacacgagattggcgaagaaggacatttagattagttaggaaaagtgcggtcaaaattaaccgcactttctgaacctcctctttagcaaagagaggagttgatcgagcattatttatatttatagggaaaataaaaaactcaatgaaaatactacacgtttgttcggaactctatccgctcttaaaaacaggcgggcttgccgatgttttaggggcattaccccaagcacagaaccaaattgggctagatgcccgctttttattgcctgcttatcctgcaattacaacaggtattccgaatactcaagtggttgctgaatttgacaacttcgctgggcacgtggtgttgcgttatggagaatataatggtgtcgggatctatttgattgacgctccgcacttatacggtcgcgaaggcaatccttatcatgatgcctattacaatgactacggcgacaactacaaacgttttgccttgctcggttgggtgggggcagaattagccacaggtttagatagctggtggcgtgcagaagtggtacacgcccacgattggcacgcaggtttgtgtgtagcatatctgttcaacaaaggcaagccagcaaaatcggtgttcactattcataacttggcgtatcaaggtcagttttcttatcatcatttgtatgaaatcggcttgccaacaggaatgttccacgtagaaggcttggaattatttgggcagatttcttacttgaaatcaggcttgttctattccgatgcaagtacggcggtaagtccaacttatgcccaagaaatcacgacaccagaatttgcctacggtttgcaaggcttgctttctggcttaaaagctcaaggtcgtttggtggggatattaaacggcgtggacgaaaatatttggcatccgaacgtggatcaatacatcccacaccattacaagctgaaatatatggcaggtaaaaagaaaaacaaagctgaactgcaagcctatttcaatttgccacaagatgaatctgctttggcatttgtgatggttacccgtttaaccgagcaaaaaggtgttgatttattaatcgaaagtgcagacgaaatcgtcaaacaaggcgggcagttgatgattttaggttcaggtgcaccgcacttggaacaaggtattcgtgagcttgctgaacgttatccacaaaatattgcggtaaaaatcggctatgatgaagccctttcgcatttaatggtggcaggtggtgatgtgattttagtgccaagccgtttcgagccttgtggcttaacccaactttatggtttgcaatatggcacactgccacttgttcgtaaaacaggtggtttggcagatacggtggtggatagcacttcagaaagcatcaaagctcgcaccgcaacaggttttgtgtttgaaagtgcaacgcctgaagctctccgccattgcttgcaacgtgcctttgccttatggcaaaaaccgcgtgcgtgggcgatggttcgcaccgatgcaatggaacaagacttcagctggcgtaaggctgcagagcaatatagaacactttatgaacgcttgtagttttattcgtaaactttcttaacaatccaccgcttgtgaaagaatattttgcaagcggtgtgattgggcttgttttttgcaaagataagcataaaattcgaactacttttgtaggctgtgtaaacaacattcacgtactcaaagagcggtcaaattttgattgatttttgcaaacgtgcgtaaattttgaaaattcacacaccctacgttaattatttcttagcattctaatagaggttttacctatgataatggataactttgattctccattccaatataatcgtcctgaaatgaccgttgaagcgattaaaaaatcaatcgtttacaaacttattttcttaatcggtcgctctccacgtgaagccagccaacgcgattggctaaatgcaacactccatgctgtgcgtgatttagtaacagagggttggatcaccactgcacgtcaaactcgagcagaagattctcgccgtgtttactacctttcaatggaatttttaatcggacgtaccctttctaatgcgatgattgcagaaggcatttatggattagcacaagaagctctttctgaattaaatgtggatttagaagaagttttagaaaaagaagtagatcctggcttgggcaatggtggtttaggtcgtttagccgcttgttttatggattctattgcgactcttggtttaccaggtatgggttacggtattcgttatgaatatggtatgttccgccaaaaaattgaaaacggtcagcaagtagaacgtcctgatgcatggcttgaaaaaggggcaccttgggagtttattcgcccatctaaacgctttaccgtagaatttggtggaaacattcatttcgagggtaaaaaatgtatttggcaagataccgaaaaagtgaccgcacttgcttacgaccaaatgatcccaggttatcaaaataattctgctgcgacattacgtttatggtcggcacacgcaggcgaagtgtttaaccttgccgacttcaaccgtggcgaacatttagccgcattagaagagcactccgcaaataaaaatttatcacgtgtactttaccctgatgattctacttggaatggtcgcgaattacgtttacgtcaagagtatttcttagtctctgcatcacttcaagatattttacgccgtcacaaacgcacccacaatagccttgaaaacttggcggataaagtggcgatccacttaaacgatacccacccagctttagcgattcctgagttaatgcgaattttagtggatgatgaaggttttgaatggaaaaaagcgtgggagatgacgcgtaacattttctcttacacctgccatactttaatgtccgaagcgttagaaacttggcctgtggaaatgatggcgaaaatcttaccgcgtcatttacagatgatttttgaaatcaatgatcatttcttagaatatgtccgcacttatgtgacaactgacaacgattttatccgccgtgtttctcttatcgaagaaggctaccaacgcaaagtgcgtatgggctggttgtctgttgtaggttcacacaaaatcaacggggttgccgaaatccattccgatttaatggtaacatccactttcgcagattttgctcgcattttcccagaacgctttaccaacgtaacaaacggtattacgccgcgtcgttggttagccgtggcgaatccacaattagccgcattgtttgataaatatatcggctcagaatggcgttgcgatttaagccaaatcgaaaaactcaaaccgttcgcacaagnaaaagcatttaaagaggctgtcgctgatattaaatttgccaacaaagtgaaattggcggaatacgtgaaatctgaattaggtgttgaacttgatccacatgcgttatttgatgttcaagtcaaacgtattcacgaatacaaacgccaaatgttgaacgtattacatattatcgctcgctacaatgaaatgcttaccaaccctgaaaaagattggcaacctcgcgtatttattttagcaggtaaagcggcttcggcttattatgctgcgaaacaaaccattcacttaatcaatgatgtagnaaatgtaatcaacaacgatgaacgtttgaaaggtcgcttgaaagtagtgtttatcccgaactacagtgtaagccttgcacagcttatcatcccagcagcagatatttctgagcaaatatcccttgcaggcacagaggcttctggaactagtaatatgaaatttgcccttaacggtgcattgacacttggtacgcttgatggtgcaaacgtggagattttggaaaacgtgggagaagataacatctttattttcggtaacacagtggaacaagttgaacaacttcgtcgagaagggtatcgatcatttgaatactatcaaaacgatgctcaattacgcacagtcgtggatcaaattattgagggtaaattctcaccagaagatcctcaacgttatcatcaactattacaaggcttgcaataccacgattattatcaagcttttgctgatttccgtagttatgtagaaacccaaaaagccgtagatgaaaaatacaaacaacgcgaccaatggattgaaagcactattcaaaatatcgtgaatatgggcttcttctcgtctgaccgcacaattaaagagtatgcggagagaatttggaaagttgagcctgttcaattaggtgattaataataaaattaaaagcaccacaagttttttacttgcggtgtttttttatggaaagtgcggtaaatttttgagatgttttttatgtgggatttttcgtgatccctatcacaatatcttgtaaaaccacttaaaaacgttacctattttcattcaattaatgatacatttgcatccgtttgactttttgtcattttaacgatgaatagacgaaggtttgttcattaatctcatcaacccaatcatcaatcagagggaaacagtatgttaattggtgtacctagagagctgcttgagaatgagagccgtgtggcggcaacgccgaaaacggttcagcaaatattgaaattgggctttgacgtgatcgtggaacacgatgcaggttttaaagctagttttgaagatcaagcatttttagaagcgggcgcgaagatcggtacgtcggctgaaatttggcaatcggatattatcttcaaagtaaatgcaccgacagatgaagaaattgctcaaatgaaggaaggggcagctctcgtgagctttatttggcgcatgcaaaatcctgagttaatgaaaaaactcaccgcgaagaaaattaatgtgttagcaatggatgcggtgcctcgtatttctcgtgcgcaagcattggatgcgctttcttctatggcgaatatttctggttatcgtgctgtcattgaagctgcgcatgaattcggtagcttctttactgggcaaattactgcagcaggtaaagttccaccagcaaaagtgttggttattggtgcgggtgtggctggtttggcggcaattggtgcagcaaatagccttggggcgattgttcgtgcttttgactctcgtcctgaagtgaaagagcaagttcagagtatgggcgcgagcttcttagaaattgatttcaaagaagaaggtggcagtggcgatggttatgcgaaagtaatgtcggaagaatttaaccgtcgtgcgatggagctttacgcagaacaagctaaagaagtcgatattattattactacggcagccattccgggtaaaccagctcctcgtttaatcaccaaagaaatggtggattcaatgaaaccaggttcggtgattgtggatttagcggctgcaactggcggtaactgtgaatatacgcaagcagggaaagttgttacaactgaaaaccaagtgaaagtgattggttatacagatttcccaagccgtttaccaacgcaatcttctcaactttatggcacaaacttagtcaatttattaaaacttttgtgcaaagagaaagatggcaatattaatattgattttgaagatgtggttcttcgtggtgtaaccgttgttcgtgatggggaagaaattccaccagcacaaattcaagtgtctgcacaaccaaaacaagaaaccaaagctgcaccagtggcagagaaaaaagaatctaaaccaacagatcctcgtgtgaaatacggtgtgatggctggtgttggcgtgttattcctttggttagcttctgtggcgcccgctgcatttttatcacatttcaccgtatttgttttagcttgtgtggtgggttattacgtggtttggaatgttagccatgcacttcacacaccattaatggcagtaacaaatgcaatttcaggcattattattgtaggtgcattattacaaattcgtcagccaacaggcaatctatttatcgatgcgttagcttttgtggcgattttggtggcaagcatcaatatttttggtggtttccgtgtcacacaacgtatgttagcaatgtttagaaaaggttaaggagcgcacaatgtctgaaggtttagtacaggctgcgtacattttagcagcattacttttcattatgagcttggcaggactttctaaacatgaaactgctaaagcgggttgttggttcggtattgttggtatgacaattgcccttattgcaaccatttttggccctcattctgaaggaacattttggatcattattgcgatgatcattggtggagcaatcggtgttcaacgtgcattaaaagtagaaatgactgaaatgccagaacttgtggcgattcttcacagttttgttggtttagcggctgtactcgttggctttaatagctatggtttacaccacgaggcgttaatgccagaaggattagatgcagcagcacaagccgcatttgtagctgaacaagcggtattaacgaatattcataatgtcgaagtctttttaggtatttttatcggtgcggtaactttcactggttctgttgttgcatttggtaaattaagcggaaaaattaattcaaaagcattaatgttaccgcatcgccataaattaaatttagccgcacttgtggtatctgcattattgatggttgcattcttgaataatccagaaagcattttccctgtgttattaatgacagcgattgcgcttgcatttggatggcacttagtggcatcaatcggtggggcagatatgccagttgtagtatcaatgcttaactcatattctggttgggcagcagctgcagcaggttttatattgaataatgatttgctcatcgttactggtgcgcttgttggttcttctggtgcaattctttcttacattatgtgtaaagcgatgaaccgttcatttgtgagcgtcattgctggtggttttggtaacgatgttcaagtttcttcaagcgaagaacaaggcgaacaccgtgaaactacagcggaagaagtggctgaattgttgaaaaatgcaagttctgtgattatcacgccgggatatggtatggctgttgcacaagcacaatatccagtcgctgatattacggcaaaattgcgtgaacgtggtgtgaacgttcgttttggtattcaccctgttgcaggacgtttaccgggccacatgaacgtgcttttagctgaagcgaaagtaccttacgatgtcgtacttgaaatggatgaaatcaatgatgatttcgctgataccgatgtggtattggttataggtgcgaacgatacggtaaacccagcggcgatggaagatccaaatagcccaatcgcgggaatgcctgtgttagaagtatggaaagcacaaaatgtgattgtgttcaaacgttcaatggcagtgggttacgctggcgtacaaaacccattattcttcaaagagaatacgcaaatgctctttggtgatgcaaaagatcgcgttgaagatatcttaaaagcattataaaaaacacgcataaaaataaccgcactttgggttgcttaagtgcggtatttttatttatagcatttaaatattatcttcatgattttccaaaatttctgaacacaagcccaatccagattaaaaattcaatgaaatgcccgttacttttattggtaaatgtcttctgtttggatagaccacatgaatttctaatttttgttgtttatattctggcaatatttcaataagctcgcctttttcaaaggctctacctaaaataaattttggtaaattagcaatacctagtcccgcttttgccatatttaataaggcaaaaccgctattacttactactttggattggattttgaaacgttgggtttgatttatacgtgaaccaacccaatttacctgattcattgcatttttataaagtaagccattgtgatgttctaaatcatcaggcgtttgtggaataccattcgtttcaagataattaggcgacgctgcaaaatgaacagtagtagttcctattttacgtgaaaccaacgagctatcttccatataaccaatacgaagagcaagatcatagccttcggataataaatcgattttcttatcattaaattcaacttcaatatgcaaatgaggatgcttagccataaaagtgggtaaatttggtgcaataaaaagtaaaccaaaatcacgaggaacggaaatcagtaaatttccttgtaatgaactggtaagctgagtaatgctggaatctgcttcatctaaatcaagcaaaatgccttgacagcgttgataatacatcattccagcttcggtaggcataatttttctggtggtacgttgtaacaatcgtgtttttaaatgttcttctaattgtgaaactaatttgcttgccatcgccacagaaatattttgttgctttgctgccaaagtaaaactttgggtttcaatgactttgcagaaaatagaaatcgcgttgagtttatccatttatagaccttttttgaaaaaatgcttgattttgccaacataactttgcactataccgccaattttacaaaattctagtaatattaggtaatcaaatgagtaaatccttggtgattgtggagtcgccagcaaaagcaaaaactattaataagtatttaggtagccaatatgtcgtgaaatcgagcgtgggacatattcgtgatttgccgacggttggttctagtacaggtgaaaaagctaaaccaatttcaaccaaaggtatggatgccgaagaaaaagcaaaaattaaggcagaaaaggaacgtaacgccttagttaaacgtatggggattgatccttatcacgattggaaagcaaattatcagattttgcctggtaaagaaaaagtggtttccgagttaaagtcgcttgctaaaaaagcagatcacatttatctcgcaaccgacttggatagagaaggggaagcgattgcgtggcatttacgtgaagtgattggtggtaacgatgatcgttttagtcgcgtggtgtttaacgaaatcactaaaaatgccattaaacaggcttttgaaaagcctgaacaattaaatatggwtcgtgttaatgctcaacaaactcgtcgttttttagatagagtggtgggctttatggtgtcgccattactttggaaaaaagtagctcgcgggctttctgctggtcgagttcaatcagttgcggttaaattattagtcgaacgcgagcgtgaaattaaagcgttccagcctgaagaatattgggaagttgccgtccttacgaataatcaaaataaacaagctatacgtttagatgttacggattataaaggcaagaaatttgatccaaaaaatcaaaaagaagcacaaagtgcggtagattttctgaatgtttcagattacgttgtcacagatttggaaactaagccaacaagttctcgccctcgagcaccatttattacatcaacacttcaacaaacggcaagtactcgcttgggatttggcgttaagaagacaatgatgttagcccaacgtttatatgaagcgggttacattacttatatgcgtacggattcaaccaatttgagtcaagatgcgcttaatatggcgcgtagctatattgaaaatcattttggtgcacaatatttaccagaaaaaccaaatttctattctagtaaagaaaatgcgcaagaggcacatgaggctattcgtccatcagatattcgagcattgcctgaatctttagagggaatggaaaaagatgcggtacgcctttatgatttaatttggtgtcaattcttagcatgtcaaatgccacctgcacaatatgatagtagcacgctgaccgttaccgctggcgattataccttgaaagcaaagggcagaattttacgttttgatggttggacaaaagtattgccacagataggcaaaaatcctgaagatcaagaattgccttcagttactgtgtcagaaaaacttgctttaaaagaagtgcaaccaactcaacattttactaaaccacctgctcgttttactgaagcggctttagtaaaagaattggaaaaacgtggtattggcagaccttccacttatgcggcaattatttccaccattcaagaacgaggttatgttcgtactgaaaatcgtcgtttctatgcagaaaagatgggcgaaattgtgactgatcgcctcaatgagtcttttggtgaattaatgaattacgatttcaccgcgaatatggaagataccttagataaaattgcctctggttcagtaaattggaaaactgaattgaatcaattctttaaggatttttctagccagctttctaaagctgaattagatgaacttgaaggtggtatgcgcccgaatagccttgtggaaacagatattaaatgcccaacctgtggcagaaatatggcaattcgtacggcgagtacgggggtgtttttaggatgtacaggttatgcattaccaccaaaagagcggtgtaaaacgacgattaatttaattcctgaagcggaattattgaatgttttagatgaatcttcagaaaccaaagcattaatggatcgtaaacgttgtacaaaatgtggaacggcaatggacagctatgtaatcgatgcccatcgtaaaatccatatttgcggtaataatccaaattgtgatggatatttaattgaagaaggctcattcaaaattaaaggttatgatggccctgttgttgagtgtgataaatgcggtgcggatatgcatctaaaacttggtcgttttggcaagtatatgggatgtacaaattgtgataacacacgcaaaattttgaaaaatggcgaggtcgcaccaccgaaagaagagccagtacatttccctgagttaaaatgcgaaaaatctgatgcatattttgtattacgtgatggtgcgagtggtgtatttatgtcagcccataacttccctaaatcmcgcgaaacacgcccagttaaaatcgctgaactagtgcaatatcgcgagcgtttacctgaaaaattagcttatttagccgatgctccacaaaaagacccagaagagaatgaagcgattgtncgttttagtcgtaaagagaagaaacaatatgtgacttctgaaaaagagggaaaagcgacgaaatggattgttgatttcaccaatggaaaatgggttgaacgaaagaaataagaaaaaaagtgcggtaaaatcaccgcactttttgtttgtaataaattttattatgttttgtagattatctgaggattaaagggctgctacaatttcattaattttattttttgcggacgcttgggctttttcaatcgcctctggcccgaatccaatgccttgtgcataaacaaattgcacgtctgtgataccgataaaacctaaaattgatttcatatattgtgtcactagattttcttcatcatacaatccaccaaatgcacataacaaaatggcttttttgccttttaataaaccctcagagccgtttgctgtatattggaaagtaacgcgcggacgtgcgataaaatcaaaatagctttttaattgtgttggaacgtttaaattatacatcggcgcaccaattatcaatgtttgtgcgttttttaattcttcgattagtttatcagacaacgccagaagttgtttttcttccgttgtttttggttctccacgcacagcaattgcagctgcggtatcaaaatatggaagaggttgttgggataaatcgcgtactacaatgttattaccttgtaatttttcgataacataatcagctaattgattagtttgcgagttatttcctgaaatgctagattttaatactaatacgttgctcatttttattccttaactgggtatttaaaagtgcggttattctagcctttatttttaagagataaagcctttagtcagaaaaacattatttcctttttgtaaaatatgggcatttatttaacaatacttcaagaaagtgatagaattcgccacgcattttttgcctaatttcgctcgttcaatggtaggaatgaagccaagtagggcaaaagtgcggttaatttttatagaattttaaatgaacacgtcacctttcgtatgggtgaccactgtataaggaaaaaacaatgccaattattactttacctgacggttcccaacgtcaattcgatcgtcctgtttctgttctcgaagtcgcacaagatattggtgcgggtcttgctaaagccactatcgcaggccgtgtaaacggagaacgtcgcgatgcgtgctatgttatcgagcaagatgcaacgttagaaattattactgcaaaagatgaagacggtttagagattatccgccattcttgcgctcacttgctcggacacgctattaaacaattattcccagatgtaaaaatggcaattggtccaactattgaaaacggcttctattatgatgtagatttagatcgctctttaacccaagaagatattgatgcaatcgaaaaacgtatgttggaattggcaaaaacaaattatgacgtcgtgaaaaaacgtgttacttggcaagaagcgcgtgatacctttgaaaaacgcggcgagccatacaaaatggcaattttagatgaaaacattgaacgtactgcaacgcctgcgttatatcatcacttagaatatattgatatgtgccgtggaccacacgtgccaaatatgcgtttctgtcagcatttcaaattacaaaaagttgctggtgcgtactggcgtggcgacagtaaaaacaaaatgttacaacgtatctatggtacagcttgggcggataaaaaacaacttgctgaatatttaacacgcttagaagaagcggcaaaacgtgaccaccgtaaaattggtaaagcattagatttatatcatatgcaagaagaagcaccaggtatggtgttctggcacaatgatggctggacaattttccgtgagcttgaaacgttcgtgcgtactaaattaaaacaatacgattatcaagaagtgaaaggcccatttatgatggatcgcgtattgtgggaaaaaacaggtcactggcaaaattacgcagatttaatgtttaccactcaatctgaaaaccgtgaatacgcaattaaaccgatgaactgcccaggccacgttcaaatttttaatcaaggtttaaaatcttaccgtgacttaccaatccgtatggcggaatttggttcttgccatcgtaatgaaccatcaggttctttacacggtttaatgcgtgttcgtggctttactcaagatgatgctcacattttctgtactgaagatcaaattgagagcgaagtaactagctgtatcaaaatggtgtacgacatttatagcacctttggtttcactaatatcgcagtaaaactttctactcgccctgaaaatcgtatcggttcagatgaaatgtgggatcgtgcggaagcaggtcttgctgcagccttagcacacaacggtcttgaatatgaaattcaagaaggtgaaggtgcattctatggtccaaaaattgagtttgcactacgagattgtttaggtcgtgaatggcaatgtggtaccgtgcaattagacttcgcattaccaggtcgtttagatgcaacttatgtagcagaagataatagccgtaaaacccctgttatgattcaccgtgcgattttaggttctattgagcgtttcattggtattattactgaagaatatgcaggtttcttccctgcatggttagcaccaacccaagcagttgtaatgaatatcactgatagccaagcagactatgtacagaaagtcgcaaaacagctttctgatgtaggtttacgcgtgaaaactgatttacgtaacgaaaaagtgggcttcaaaattcgtgaacatactttacgccgtgtgccttatatgctcgtttgtggcgataaagaaatcgcagaaggcaaagtggctgtacgtacccgtaaaggtgctgatttaggcacatttactgtggaagaatttgcggaaatcttaaaaaatcaagtaagaagccgtgaattaaagttattgaatgaagaataatacttctagaaaataaccaatataatttactgtttaaatagtgagttcaaacggtgatcgtttaagcgatcaccgccctttttatctatttcatatctattgagatttaatttattttctaataagaagctgcttttaatatgctgacaaatctgcctgatttttttagagctttttgcgccaacgcatctattgtggcttttgtcgctaactgatctaaatgttgataggtataaatggcatctggattatcttgttgccagtaactttcttcaataattgaagcaattgaaactaaagaatcaaattcacgtcgaatctgagtatgttgttccgctagttttttacgtaataagttttcatcaatgccattttttataatgtcatctagtacctgatttgtaagatacgtaagttcctccacgcgcttagggtcgcaactaaattcaattttcccctcaatttgtggtgcataaacatcttgcataaaccaactatttacagaataaataccagaaactttttcacgtagaattaagcgtaatttttcttgcacaatatccgcaagaatattgaataaatatttttgttctgttcgccaagtattatctgcggtaaggtatatttctacatcagctctcggttctttcaaaccattcataataaatgattgagttggtgtatgaataatagtcgggacaaaatggcggatctgagtttttgattcaatagaagctaaataacgttctgccaatttctttacttgattaagttcaatatcgccaataataaaataggtaaaatctgttttatctaaaatataatgttgataagcgttatttaattggtttttatcaaatgataattgttgtgcttgtttttgagtatagacggtttcaatatttggaaaacgtagttttgaaacggcttgcataaattgtgtttctaaatcaatctgtttgaaataatcacgggtttcacgtcgatatttttctaaggcaagatcggatataggagaagaacgtaattttaagcggaacaatgtcagtaaattttccaaatccttaggtttagatacaccagtaaaaccttgtttatcatcatcaatcacagttgcaatcaccaatggatcgcgcgaaaaaatttgattaaccgcagaaagagaaagttctccaacacctgtttcatcaactacactaacggcagcacgtaataagtgatagtccttatttgggatagaacgtaaaccaccttgagtaacagcacgaaaatgtacttgatttggagttttgtcactatagtggtagatcaatttacttccattacttaaacgaaattcataaatatcgccgcgatcccagtatttttcttgagaaagtgagcctgtgttaaatgttaagtgcggtaatttttcgatttgttttttttcatcccattggtgttgttgcatttccattacattgttccaacgagtttctatttctgcaacatcaaaaggcaaggctttttgtggcaaaggttgagtgattaataataattttncttttaatgctaaggtttgatttaacgtgcgtngtaaatcagctaatgtaatttgagataaaaaacgtttattgagttcataacgatcatttacgctcaataccacttgcttatttgccacagaagtaatgagatcatcggcaatttttaaactaccagaacgaatatttaattgtttttcattgagttgagttaagcgtttaatctcaccgcttaattcattttgagtaaaaccttgttgttttatactggcaataaaggcaaataatttatctatcgtttttgaatattgtgtatctataagctggagagaaaaaatgctttgtagtgtttctttacctaaatgagtgcgataaaaatttgcagaatctacgccattttctgtttccttttcccattgctgtaaacgtaagtnaagcaatcgagtggtaatttgctgaattaattcctgtttataactcgctaatgtattggtttcaattgtattttcaaaaaaacttaattcaatactcggaattgttgtgccttgttcagaaatagaatctaatcgccatttgttgataagaggaatattaaaatcaattttttccaatgttgttttagtaattgggttttcttgagatagattttgttttaatagttttactacttgttttgtatcaatatcgcctacaataattactgacatattatctggtcgataccatttgtggtaaaaatcagcgacgcgtttagctgaaattgttttaataatatccatatctccaataggatcacgcaacacataacgagaacccgccatttcaatagcacttttcttattgccaatacgtagcattgggcttaaacgtctccgccattcttcttgtactacgccacgttcgccatccacatctttaggcaaaaaagtaatattattcatccattcattgatgacatcaaaagccaattctaatttttgctgattgttgctatctaaatttaaagtatagactgtattttcaaaatcggtgaaagcattaatatctcgtgcaaacttcattccaagtttttctaacgcattaataatttgattttctggatatttctttgagccattaaatgccatatgttcaactaaatgagcaatgcctttttgatcgtcatcttcgtgcatagatccagcattgatcactaatcgaatataaacgcgttctttgggttcagtattttttaatacaaaatattgcagaccatttgatagtttaccgtgctgaatatttggatcaaaaggtaaattattattgggcgatagttccaatgattgacaagcaattagtgaaaagataagtaaaaaaagtgcggttgtttttttcattattttacctagaaaaaagaaaactctacgctaagtaaaaataagcgtagagtagggctagtggatgtttcaaaagcccacaagccctatacattgaagaatattagaattgatagccaacttctagccaaaattcacgcccaggcgtataaacaccgtattcatcgctagtggaaatagtagtgactttatttttacgtgttttattgagcacatttaaaatatctacttgcatataaacgctatgtttaccgcgaatggtgggttgccaacggatactactgtcccattgtgtatgtctgccatagtgatagctacggaagcgtgaaatgccatcaccgttatcgccatcaagttcctcatagctacgaattggggctttcatatacactttattagaccaagtgatattgtaatctggtatcgtcatatcaatacctaaacgagcaatccaatcttctgtactgctattaacttgttgtagcatttgactacgagtcattaattttccatctaaatagacgggttcatttggattaaattcattacttacatcggctcgttttgtatttaaccaatcaaaaccaagtgacgtagtccaataagttttacctagtttccaaggttcaatattattaagttggaaagtataaatatcaacaccaaacggatgtccattgatataactagtttttctttcaccctgtataggctctcgtttcaatatgatacgattcttattatcacgatgaatataaccaagttttagtgcgaaattacccatattttgatcaaaacttaaacttaattcatctgcataagggctttttagggatgaaaaattttgatgctgacgtgttgaatcattattgagctttaaaataccattcgctaattttaacgaagcaaaagaacgaccgtaataacgatttaaacctagtgtaaatcctgtattatcccaagggtgataacgtgcaacaaaacgcggagcaatattattgttttttaaataatcatcacgttcaatacgaatgccaggacgcaattcaaatttattccattttattaaatcttcagcataaatagcgatattttgataactggttttaacacgaccttttgatgttgtattttctgtagaagttggaggttcttccatacttccatcactttttaaagtagataatattatttttgaatgaacatcttgtggacgatagaattgatatttagttgcctgataaattccaccaacagaaatagaatgctccgtagaagctaaataaaaaggatccattacatattcagttgaaaaatgcaaattatcctgaattaattgactattgccatacccgcctttttcgaaattataaagtggctcataatattcatctaacaccgatgttatttcaacactattcgaggatgatttacgcttatcctgaaaacgatcgtatgctaaggtatttgtccagacgccagagttgaatgaatgtacccaagcaagcgttgctcctaatgcttgatgataatcgcttacgttgttatttatatttnccttgaaatatttcaattccttataatttgaataacgtaaaccaaattcaattcgttctttttcttgcggtgtccaattgaaatttaataaaagattatcggaaagccgttgatgattttgtttgtctaactgtgctttattattggcatctttatcaaagccaattaaacgattttgttcaatagatgatgttctacggctatagccaaaaaccattcctaaattatcatttagccttttttcagccaaaatattgaatgtttgtttattgtatttaggttgtaactctgccactccgacatcatctggacgtaccaacttcagtattttttgtactgagtctccagcttccatttttgcccaagaggaatttgtcgtgcgatatttaagttttatgctatcagtgccactatattgtttcgttttagcgataactgcccctcccataaatccccctaagctagcagaaatattactatcttgtacttccactttagaaagcatagtcgcatcaaaaaaataagcttgagtgtgactaattcctggcacaacttgcatagcaccgtcaaaaatactgctatcaatagcaagatcattatttatattgacattatcaacaaagtaggcgctttgatttggatcggcgccgttaattgaaatattttcaggcttgatttcaccacgttgaaaaccattttggtcgctattttcataacgaatatggggattggaacgaagataatcagtgatgttaccgtttgatgttggtgttttacttatctcatcagaagaaagagttttaacagaagaaagcgatttattattgtcaccatacacaacaatttcgggcaatatatttttattggttgtttcaatagttttccccataacaaatggactgacaaatgttgagcagaataacaacattaatggctttttttgatacatagtatagttccctaaaataaaaatacaaataagaatgattatcattatatttttaagatttatgaatgcaaggggaattcgacttaaaataggtatcaaataaataaaaaaccgcactttaaaagtgcggttatattcaattctgtttgtatggaagaaattattctacgccaaccattacagaagttgctttgatgattgcgtatgcttctttaccaacttctaagtttaattctttaactgctgctaaagacacagtagaagaaagtacgttaccgccaccgatatcgatgtgaacgattgcatttactgaaccgttttcgattgaaacaactttaccctttaattggtttctagcactaattttcataacatttccttgttagttagggtttaaaagagcctgtattttatcttacaaaaaacaagtcgtaaataaacccagagtttaaaactttcagaaaattgaccgcacttttataggcattttgcaggtttcggcaagcctgctaattttgtggcttgttttgctgggccttcaggaaataagtgttgcaaataacggctattacctttatccgcaccaagcttttcagccatggcttttaccaacatacggatggctggggaggtgttatattcttgataaaagtctcgcacaaagtaaatcacttcccaatgggcatctgttaattcaatactttctaactgtgcaatagcacgagcggcatcttcgttccattgttggctatggagcaaataaccgtctttgtcagtttcaacttcaattccattgatattcaacatattaatttacttctttaaagttaatcatttccttgtttgaaaaatcagtttgatcttcgtcctcaaattgcattggcgtgattcgttcttcatcaaatgcggtatcgccttcaatgccatcaattagttgcccatgtttgatgcctttgaaatcaaataatttcggatcacacatatgtgacaatgtaatgttttgcattgcgctaaacatagtttctaagcgtccaggatattgacgatcccaagtattaagcatttcttttacgacttggcgttgaagatttggttgtgagccacataggttacaaggaataatcggaaattccttcgcgatggcatatttctcaatatctttttctttgcaataagcaagcggacgaatcacaatttgtttgccatcatcagaaatcaatttaggtggcatggattttattttgccgccataaaacatatttaaaaatagtgtcgctaacatatcgtctcggtggtgccctaaagcgattttggttgcaccaagttctgtggcggtacgatataaaattccacggcgtaggcgagagcagagtgaacaagtagtttttccttctggaattttttctttcacaattccgtaagtattttcttgtacgattttgtaatcgacgccaatgctttctaaatattcaggtaatacgtgttctggaaaccctggttgtttttgatcgaggtttactgccacgatatcaaatttaatcggtgcactttgctgtaaattcaacaaaatatcgagaagcgtataactgtctttgcctccggataaacacaccatgactttatcgccatcttcgatcataccaaaatctgcaatggcgttgcctacattacggcgaagacgtttttgtaatttattgaaattataggtttgttttttttcttgttgggctaactgggttaattcgctcattctgttatctttagttattcatgaaaggcgcacattatacgtgaaaaataggaaaagtgcggtcaattcaaaagaagatttttaagatccgcaaaaaatcctgtataatctttccaattttttgttcaattttaacgctttgcaattcaatgattgaaacatcccaaactattcctgaactcgtctcttgggcaaaagatcgcgagttttctttgaatttacctaccgagcgcttggttttcctgctggcgattgcaatttataacaacgaacgtttagacggcgaaatgttagaagctgatcttgtggatattttccgccacacgatgaatgcttttgagcaatccacggatgccattgcaacacgagcgaataatgcaattaatgaattagtgaaacaacgtttgttaaatcgttttagtagcgaatttactgagggtttggcgatttatcgtttaacgccattaggtgttggcgtgtctgattattacattcgtcagcgtgaattttccgcattgcgtctttctgtacagctttccattgtggcagatgaaattcaacgtgcttctgattcagcagaagagggcgtggagaataacgaaaacgaacattattggcgtcgtaatgtgtttgcgccattaaaatattccgtggcagaaatttttgatagcatcgatctttcacaacgtatcatggatgaaaaccagcaaagcattaaagatgaaattgcagagcttcttactaaagattggcaagcggcaatttcaagctgtgaacgtttattagatgaaacatctgggaatttgcgcgaattgcaagatacattaaacgccgcaggcgataaattgcaagcacaattattacgtattcaagattgtgtgattgggcgtgatgacttgtactttatcgatcaattaattacagatttacaatctaaacttgaccgaattattagctggggacaacaagccatagacttatggattggttatgaccgccatgtgcataaatttatccgaacagccattgatatggataaaaatcgcgtgttttcacaacgtttacgtaattctattcatcattattttgatcatccttggttcttatggacagcgcaagctgagcgtttagtcgatctgcgcgatgaagaaatggtgttgcgtgaagatgatgctttaggtgaattaccagaagaattgcaatacgaatccctttctgatttacacgatcaaattgtagagcatatgcaaggcttactgattgcttatcgtgaaaataaccgtccgattgatttgagtttagtgttaaaagaacaactggaaaattatccactttctcgtcattttgatgtggctcgaatcattgttgatcaagcagtacgccttggtatggcgaatgatgatttatccggtatttatccagattggcaagcaattaataaacgtggcgcagaagtgcaagcgcatgtgattgataagtattgatttcgtggcttattaaaaaacgaatttataaaatgagaaattaaccatgacagatattcaagatgtaattnccccaaaactcgctgtggcgattgcaaatccaatatttccagcggtggatagtttattgcgctcgggtcgccatatcagcacggaacatttagataatcacgcatttttaatggatttccaaaatgaattggacggtttttatcgtcgctataacgtggaactaattcgtgcgccagaaggattcttctatcttcgcccgaaagcaacgacattaattgcgcgttcagtactttctgagttggaaatgcttgttggtaaagtgctttgttatctttatttaagcccagaacgtttagcccaacagggcatttttagtacgcaagaagtgtatgatgaattattaaatcttgccgatgaaggaaaattattaaaagcagttaatcagcgttcaagtggttctgacttagataaacaaaaattggcagaaaaagtgcgggctgcaattggtcgtttacgtcgtctaggtatgattcaaactgttggtgaacaaaatagtgggaaatttacgatttctgaatctgtatttcgttttggtgcggaagtacgtagcggagatgatccattagagtcccaagctagactcattcgtgatggggaagccgcaacacctgattccttagcgttggaaaaacaagcgcaattaatggaaaacgatacgaaaagtgcggatgaaattgacgaagaatttgacggagaacaagaataatgtctgatgtttttgaattagaaaatgaaatcgaattagagagcgatgaagtcattctggaaaatgaaaacgtcgaagaaatcgttgatgcacctataccttttagcatgacgacaaataatggtatagagcgtggtaaatttcgttctttaaccttaattaactggaatggtttttttgcccgtacttttgatttagacgagttagttaccacgctttctggtggtaacggtgcggggaaatcaaccacaatggctggatttgtgaccgcattaattcccgatttaacccttttacatttccgtaatacaacagaggctggttctacaggcggttctcgcgataaaggtttacatggtaaattgcgtccaggtgtttgttacgcagtattagataccattaattcacgtcatcaacgtattcttgttggtgtgcgtctgcaacaaattgcaggtcgtgataaaaaggttgatttaaaaacgttctcaattcaaggtgttgaattatctcaaaatccaaccgcacttttcactgaaacagtgggcgaacatcaagcacgcgtccttaatttaaacgaactcaaagataaaattgaaaatatcggtgcgcaatttaaacaatatcattccattaccgattatcacggcatgatgttcgatctcggtattattccgaaacgtttacgttcagcatcagaccgaagcaaattctataaacttatcgaagcgtctttatacggtggtatttccagtgcaatcacacgttctttacgtgactatttattgccagaaaatttaggtgtacgtaaagctttccaagatatggaaagtgcattgcgtgagaaccgtatgactttagaagcgattaaggtcacgcaatcagatcgtgatttattcaaacatttaattactgaaaccaccaactatgttgcttcggattatatgcgtaatgcgaatgaacgccgtggcaatattgaggctgcattagaatctcgtcgtgagtggtataaagcaaaagcagagcagaatttatctcaacatcgtttagttgatttaagtcgagaagtggctgaattggcagaaagtgaacgtactttagaagttgatcaccaaagtgcggttgatcatcttaatttagtgttaaatgctttacgtcatcaagaaaaaatcacgcgctatcaagaagatattgcagaacttaccgagcgtttagaagaacaaaaaatggtggttgaagatgcgaatgatgcgttagaagaaagccaagcccaatttgagcaaactgaaattgaaattgacgctgtacgatcccaattagctgactatcaacaagcattagatgcccaacaaactcgcgcacttcaatatcaacaagccattgcagcccttgaaaaagcgaaaacattatgcggtttagcggatttaagtgttaaaaatgtagaagattatcacgcagaatttgatgcgcatgcagaaagtttgactgaaaccgtacttgagcttgagcacaaaatgtctatttctgaagcagcgaaatctcagttcgataaagcgtaccaattggtatgcaaaattgcgggtgaaatgcctcgttctacggcgtgggaaagtgctaaagaattattacgtgaatatccaagccaaaaattgcaggcacaacaaacgccacaacttcgcacaaaattacatgaacttgagcaacgttatgcacaacaacaaagtgcggtcaaattacttaatgattttaatcaacgtgctaatttaagtttacaaacggcagaagaattagaggattatcacgccgagcaagaagcgttaattgaagacatttcagcaagactttcagaacaagtggaaaaccgttctacgcttcgtcaaaaacgtgaaaatttaaccgcactttatgatgaaaatgcgcgtaaagcaccagcatggctgacggctcaagctgcattggaacgtctagaacaacaaagtggcgagaggtttgaacatagccaagatgtgatgaattttatgcaatcacaacttgtgaaagaacgtgaactcacgatgcagcgtgatcaacttgaacaaaaacgtttgcatttagatgaacaaatttctcgtttaagtcagccagatggttcagaagatccacgcttaaatatgctggcagaacgttttggtggagtactgctttcagagctttacgatgatgtaacaattgaagatgcaccttatttctccgcactttacgggccttcgcgtcatgctattgttgtgcgtgatctcaatgctgtgcgtgaacaacttgcgcaattagaagattgccccgatgatttgtatttaattgaaggcgatcctaccgcatttgacgacagcgtattatccgcacaagaacttgagctaggtgttgtcgtgcaagtttcagatcgtgaattacgctattcaagattccctgaaatcccattatttgggtgtgcagcacgtgaaaaacgtttagaagaattacaaattgaacgtgatgaagtggcagaacaacatgcccaaattgcgtttgatgtacaaaaatgccaacgtttacacgaacatttcagccaatttgttgggttgcatttggcgttggcgttccagccaaatccagaagcgttaatgtctgaaattaatcgcgaacgcaatgaaattgatcgtgaattaaaccaatttaatagcggcgaacaacaattacgcattcaattagataatgcaaaagaaagactgcagttactcaataagttaattccacaactcaatgtattagctgatgaagatttaattgatcgtattgaagaatgtcgtgagcaattagatattgcagagcaagatgaatattttattcgtcagcatggcgtaacgttgtcacaattagagccgattgcaaatagtttacaaagtgatccagaaaattacgaaggcttaaaaaatgaattaactcaagcgattgagcgtcaaaaacaagttcaacaacgtgtatttgcgttagctgatgttgtacaacgtaaaccgcattttggttatgaagatgcagggcaggctgaaacttctgaactcaatgaaaaacttcgccaacgtttagaacaaatgcaagcacagcgagatacgcaacgtgagcaagttcgtcaaaaacaaagtcaatttgctgaatataatcgcgtattgattcagttacaaagttcttacgatagtaaatatcagctcttaaatgagttgattggtgaaattagcgatcttggcgtgagagctgatgatggtgctgaagaacgtgcacgtatccgtcgtgatgaattacatcaacaactttcaacgagccgtcagcgtcggtcttatgtagaaaaacaactcacattaattgaaagtgaagctgacaacttaaatcgtcttatccgtaaaactgaacgtgattataaaactcaacgtgaattagttgtggcggctaaagtgagttggtgtgtggttttacgcttatcacgtaactctgatatggaaaaacgccttaatcgccgagagctcgcttatttatctgcagatgagttacgttcaatgtcggataaagcattaggtgcgttgcgtacagcagtggcggataatgaatatttacgtgatagcctaagagtgtctgaagatagtcgcaaacctgaaaataaagtgcggttctttattgcggtgtatcagcacctacgtgaacgtattcgccaagatattattaaaacggatgatccaattgatgccattgaacaaatggaaattgagctttctcgtttaacggctgaattaactggccgtgagaaaaaattggcgatcagttctgaaagtgttgcaaatattatgcgtaaaacgattcagcgtgaacaaaatcgcattcgtatgctcaaccaaggtttacaaaacattgcgtttggtcaggtgaaatctgttcgtttggtagtgaatattcgtgatacccatgccatgttgttggacgcactttctggtcagcaagatgaatatcaagatttattcaacgacaaccgcatcaccttctctgaagctatggcgaagctctatcaacgcatcaatccacatattgatatggggcaacgcacagcgcaaacaattggtgaagaattgttagattaccgtaattatcttgagcttgaagtggaagtattccgtggtgctgatggttggttacgtgcagaaagtggcgcgctttctacgggtgaagctattggtacaggtatgtcaattctcttaatggttgttcaaagttgggaagaagaaagccgtcgaattcgtggtaaagatattgtgccttgtcgcttgttgttcttagatgaagcggcgcgtttagacggtaaatctatttctaccttattcgaactttgcgaacgtttagatatgcagttacttatcgctgcgccagaaaatattagcccggaaaaaggtacaacctataaactcgtacgtaaaatcgcaggcaaccaagagtacgtacacgttgttggtttacgcggattcggtgcgacagaataaaaaatagaagggaagtgcggttgaaaacttcggtgtttttgaccgnacttaagcctttaaggaaggaataatgaaaatctttacatcaaaaaaaggacaattatcacagctgaagcagcaaaaatttaagctggaaaaggatattcagcgtttatttgaagaaaatcttaccttattaagtggctatatttttattcgttcggaattttctattaaaaattcacgtattgataccttagcttttgatcctgaaactcaagcctttgtcattattgaatataaaagacaacaaaattctagtgtggttgatcaagggatttcttatcttaatttgatgcttgaatataaagctgattttattgtggaatataatgaaaagcaaaaagtcccacttaaaagaaatgatgtggattggtcacaatctaaggtgatttttgtttcacctgcttttaatgatttccaaattcaagccacgaattttaaagatttacctattgaattatgggaagttaatcgctttgataatgatattattacgctcaatattattaataaatcaaaatcagcaccgaatattaaagctgtttctaatgaaaagagagaagaattctcaatattaaaagaaataaaagtttatcaagaatctgatcacttagctgataaaactgattttattcaagaactatacgaagattttaaacaaggcattttaaatttagatcctgatatcgaaattaataccagaaaactttacattgcattcaaaaaagatcgaaatattgcagatattcgtatccaacaaaagaatttaaaaatttggattaatcttccttatggagagttagacgatcctaaaaatttagcaaaaaatgtatctaatactggtcactgggggaatggagattatgaaatcaccattgaaagcacccaatatcttgaatacattatgagtttaattaaacaagccattaaggattaaaaatgcacaatcttatttttgccattctttgcagcgtagcagtttcagttttactgaaaattgcccgtaaaaaaaatatcattattgaacaagctatcgcattcaactacattacagccatcactttcagttatttcttacttaaacctgattttaaaggtttagaatttactgattacattgcacaaagcgaaaattcacccatttttttagcactaggtttattgctacctagcgtatttattattatgtcaaaagcagtggagtttgctggaattgtacgttcagatgcagcgcaacgtctttcgttatttcttcccattttagcagcgtttttaatttttcatgaaacactaagccaatctaaaatcattggcgttgtattagcctttattggtttgttttgtttattaactaagccaactcaagggcaaagtgcggtgaattttaaaggtgttttaggattaatcggcgtctggtttggttacggcatcattgatattttattcaagcaagtggcgaaaagcggcggtgcatttcctgcaacattgtttatttccttctcgctggcagcctgcgttatgtttatctatttattcttaaaacgtgtgcaatggacatcatcaagtgtaattggcggtatcgttttaggtgtattgaatttctttaatattttattctatataaaagcacatcaaagttttnctggaaatccaacgcttgttttcgctggaatgaacattggcgtgatttgtttaggcacgataactggtgcattagtttttaaagaaagaattagcaagctaaattggctaggtattattttcagtttgtcggctattttctgcctatattatttagataaaattatcgcgtaaaagagagtagtcatggtaaaagatttcagcttttttatttacgattatgaaagttttggtgtaaatccagcaacagatcgccctgcgcaatttgcgggtattcgtacagatgctgattttaatatcattggcgaaccaataatgttttattgtaaacaaaccaacgattatttaccggctcctgaagccgtaatggtaacaggaattacaccacaagaatgtaatgaaaaggggctttcagagcctgaattcgccgcaaatatcttagcagaattttcccaacccaatacttgtgtcatgggttataacaatattcgctacgatgatgaaatgacgcgttatacgttttatcgtaatttcattgaaccttatgaatacagctggaaaaacggaaattcacgctgggatttgttagatttagtacgggcctgttatgccttgcgtccagaaggaattaattgggcttatgacgatgatggaatgccaagtttccgcttagaaaaactcactaaagcaaatagtattgagcatgaaaatgctcacgatgccatggcggatgtatatgcaactattgctatggcgaaattaattaaagaaaaacagcctaaattattccaatatttctttgaaaatcgcggtaaaaaagaaatcgaaaaattagttgatacaggcgcaatgacacctttagtgcatgtttctggaatgctagggaattatcgaggaaattgcacttgggttgcacctttagcttggcatccgacaaaccaaaacgcattaattgtgtgtgatttaactggtgatatcgataatttattagccaaaagtgcggatgaattacgagcagatttatatacaaaaaaattggaattagaagaaaggggagtttcatccgttccgttaaaacttgtgcatatcaataaatgtcctattttagcaccagctaaaactttgttaccagaaacagcaaatcgattgggtattgatcgtcaattatgcttggataatcttgcaaaattacgagcatcttttgatattcgtgaaaaagtggcggatatttttaatgaagaacgtcaatttgcatcgaatgataatgtagaaactgagttatacaatggcttttttagcaatgctgataaaaataatatggctattttacgtagtttacctgcagnaaaattatctgaacatggtttagcttttgaagataaacgtatccttgaattattgttccattatcgcgctcgtcatttttataaaaccctcacacgcgctgaacaaattaaatggaaaaaataccgacagaataaacttgaaaaaagtgcggtagagtttgaagcaagtttacaacgtttagtagaggracattcagataattctgaaaaactatctttgctacaacaagtatatgaatatggtataaaattactaggttagtcgatacgttgtcacattttgtcaaaaagcacgttttaataaaaacgtgctttttttgttgtttttctgggaagaaaatatccaagaagttttccagattttacgtagcgtaatcacatagatttaagcttatttcactttacatttcctttacatttaaactcatccgntcaataactctataaaatgacgcgttacaacgtgttatctagccttattttgtcttgttttgctagtacttgtaacttgtgtataactgtgtgatttatttagtccgtagtttccgctaacccgataactaatttcgcataatataaattatgttaaattgcaaaaatgcaaagtaactttaattataggctataaagagattatttctcctctcttaattagttatacttaatcaaataagatgaacgagtaaattaatttagagccatactatgacgtttatttacagtgttcgattcatgggtgtgaaagtactgcagcatttaaagatttatgcttgattgataaagatttaggtgatttagcaactgctacataatctaaataatataagtttagatgggtgaaaaactaccaagctgtgttttttatgtatctaagctctccactagcccaccatttttgattttctgatgtgttatttactaccgtgtcagctaatacttgcaacatgtattatcattgaatttctttattattttttgatatgacaaagcgtttaggtatgataaacgaaaaactactacccttcgtttcagtactttcaatatttaaatgagaatgatattgtaataaagtatgcttcacaatagctagtcctaaaccacttccaccagttaaatggctacgagattcatcacaactctataaaaacgttctgttaaatgtggaatatgctgtggtgatatgccaaccccattatctatcacgttaaatttaataccctgttcacaagtttcccattgaatttgaatatgacactgtttaccagaatgcttaatagcattataaattaaatttgaaacggcacttcttaattgagattcatttccaaaaataatgatattaggttgaataataaattcaatgtgatgattataagtatttaatatatctgtatcttttcttaaagaatttatcatggctgacatatcaaatttacgaaaatccttatctgaagttgtttctatttktgctaaaaaattaaattgttgtaatagatgttccattcgttggctttgctcttgcattgcmaaaatagcctttttttgtagagggttctgaatattattatctgcaagaatttctaagtaaccttgtaatacggttaatggagtacgtagctcgtgattaatattactcaagaatttttggcgtgaattaagtaaatgaatcatatctgtaatatctcgagcgataactaaaatcatatgagaattataagcgtgcgactgcacctcaatataacgttgattataagttaatagtactaacggtcgtcttttttttggactgaaaaaataatgtttaaattgtycataaaaaataacatcaaaaatattttcctggacttttttatcccaacaaaaatcaaacatctgtggcgcaattgamttacaccaagaaatattaccattatgctgacagataataattgcatctggtaaatacttaatatttytatttattkgagataacaaacgtaaactkgcacattttycttkgtaaattkgatgacgatggtaggctycagttkgagagaatgtycctaattgtaataaagagaatttattatcttgctttaaattgagatatttgagtaaacgatattcattaatatgatgccaagctaaaattaataaaagtattattgcaaaccaaagaataaaatcagaagtaaataaggaaataatgattgccaaatttatttcaacaataaaattcaatatttttttcattgtttatctcgtaaataactagaaaatcgataaccagatcctcgaactgtttggatgtaatgttcacattgaaaaggggctaaattacggcgtaaacggcgaatatagctatcaacagtgcgatattcaacttctagatcattatgccaaatacgatttaacaattgttctctagaataaactttttcagggtgcctcataaaaaaatgtaacaatttaaattctgtrctacttaaattaatttcctgctgttggaaaaacactctctgagcattttcatcaatggaaagttcatcgatttgtataaattgactttgttgttcataaattctcctccatactgcctcaatgcgagctaataaaatttgaggtgaaaagggtttagtgatgtagtcatcagcccctgcatttaaacaggcaatacaatcttcttctgtacttttagctgtgagcataataatgggaatcgcagcatagctttcttgctttttaatatactgtataaatggtatacctgaacgaccaggtagcatccaatccaataatattagtttaggattttcttttatcttgtttatcgctgttttgaaatcgctcgcttcaatcacatcatagtatttttgagataaaaacagtgcgatcatttcacggattgcacattcatcttcaactatcagaatttttctcgtcataatactccttcatttgatttatggcataaaagtgaagtgagaaataatacattctcaccaaacttttactttttaataagagaactcaaaataactaccccattttaccgcgaatataatcttctgtacgttgtatcttgggtctatcaaaaatttgttgtgtttgaccaaattcaactaattcacccaaatacataaatgccgtatagtcggagcaacgtgtagcttgtngcatattatgagttactataaccacagtataatcnngtnttaactcccgtaatgagttcttcaattttcatagtcgaaataggatctaatgccgaacaaggttcatctaacaacaacacactaggtttaatagcaatccctcgagcaatgcacaagcgttgctgttgtccgccagataaactatctccgcttttatgtaatttatctttcacttcattccaaagagcggccttagtcaatgcccattctactcgttcattcatcttttcttttgataatttttcaaacaaacgaacaccgaatgcaatattatcataaatcgacattggaaatggcgttggtttttggaaaaccataccaaccttagcacgaatcagagaaatatccatctttgttgtgagtaaattttcaccgtctaaattaatttcaccagtagctttttgatttggatatagttcaaacatccgattaaaactccgcaataaagtagatttaccgcaacctgaaggaccaataaaggcggtcactttattcttagcgatacgtaaattaatgttttttaatgcatgaaaatcctcatagtagaaatttagattttgcacagctattttggtttcttgtagactaatcatattgcctcattattttttatgttgaaagaagagtcgagtgaaaatgtttaagcaaagcacaaataatgttattagagctgcacctgcccaagctagattattccaatctgtaaaaggacttgctgcatattgataaataactacaggtaaatttgcgataggttcattcatattccaagatagaaattgattagacagagcggtaaataatagcggtgcagtttctcctgaaattcgggcaactgctaatagcacgccagttaaaatccctgatttagctgctcgataacaaatcatcataataacttgccattgagagcaaccaagagctgccgctgcttcacgtaaattatttggtacaagtaataacatattgtccgtagtgcgtaccacgataggaataagcaataaagctaatgcgaatgctccagcccaccctgaaaaatgctcgatttttgatacatataagctgtaaacaaacaaaccaataataatagarggggcagaaagaagaatatcattargaaaacgggtaatttgtgcgaaacggctataacgaccatattctgccaaatacgttcctgccaatacccctataggcgtgcctatcaatgtacccgcaccgacaataaaaaacgaaccaatcagtgcatttaacaacccccctttttcattaggggcaggggtagattgtgtgaataaatcaattgataaagctggaatgcctttggtaattagagtgaataatatccaacacaaccaaaataagccgataatgactgaaatataggaaagccctaacattaatttattgtgtgttttacgccaataaaaacgcaagttttgattagttttcatcttatttcccttttgtttgttgcatttttgtaatcattaatcttgataaaatcaataccatagttgtgataacaaagagaagtaatcctaattccatcaatgcagatttttgtaatccacctgcttcattaaattcgttagcaatagcagatgcgattgaggtagaaggtgaaaataaggaattaggcaattgaaacgaattacctataataaaagtgatagccattgtttcgcccaatgctcttcccaatcctagcatcacactcccaacaagccctattctagtgtgtggtacaatcacttgtcgaaccacttcccaagtggttgcacctaatccataagcaccttcttttaacattggtggtactatactaaagacatcccgcattacggatgcaataaaaggaatgatcattatggcaagcactaatcctgccgtaaataaaccaacaccaaaaggtacgccagaaaaaaataattctaatccaggtaaattccccaaattgtcaattagtactggctgaatatgttcttgaaataatggaacgaaaacaaacaacccccacattccgtaaataatagaaggaattgcagctagcatttcaattgcaatgcttataggacgttttagccaattgggagctagctccgttaaaaaaatagcaataccaaatgaaatgggtactgcgataaataatgcgatacccgccgtaataagcgtacctaaaataggaataattgccccatattgttcttgtacaggatcccaatatgtttctaatagaaaactcccaccaaaacgtttaatactttcccagcttcctatgactaaagaaattaaaatagcagcaagtaaaataaacacaagcaaagcaaacaatgccgtagtctgtttgaataatgattcaatccatgtttgattaaaatatttccgactttttgtgagcataagtattttccaaaattatttaagataaccgcactttattaatgttaagtgctaggttttgtataaagtgcggtataaaataaagagattttattgttttagctctgttttccattgacttttaatggtagataccacatcagctggaattggcacataatctaattcagttgccgcatcttgccctcttgagaatgcccaatcaaaaaaggctaatacatttttagttgtttcaggattgtcagaatatttatttaataaaataaaactcgctgccgtaattggccaagatttttcccccgtttcattggttaatataacacccattcccgccttttcgtgccattttgcgtgacttgcagctgccatgaaactttcattagaaggctgtacaaattgccctgcttgattttgtaatgaaatccaagcaagctgattttgtttggcataggcatactctacataaccaatgctgtatttcatttggcgaacataagaagcaactccctcattcccctttccaccttgacctgttaaccacttcactgatttaccttcaccaacttgatttttccaatcgttcgaaattttagatagataattagtgaagccaaatgttgttccagagccgtctgaacgatgaatcacaataatgtttttatttggtaaaggaagcgttggatttaatgcaactaagtcaggatcgttccattttttaatcttaccaaggaagatttctgctaacagcttacctgataactttaatttaccaggtttaatttcaggcaaattaacaacaggcactataccaccgataaccgcagggaattggactagttggtgttgttgtaataattcggatttcattggatcgtcagaggcaccaaaatcaaccgtttttgcaataatttgctgttgtccgccgcccgaaccgatggattgataattaactttattcccagtttctttctcatataaagatgcccacttcgcataaattggataagggaaagacgctccagcaccagtgatgctattagcttgagcaaaaggtaacgtacctaaggttaaaacgtaataagattttttttcattttatgcataaacataacaaattctccttgagtgttatttagattgcgtagcgaagtgtagaaaataattgtgacagtttgatgacaatatgaaaaattttaaatggataatcaaaagaaagtagttataagaaaagtacaggtaaatttgaccgtgtttttctagcagaaggatattacatttgtcaattaattgataacgatctttaggtttaataaaagttggtaagttttcatgtttactcgataatctaaattttatccaaatctaaggaggaaaataaagacatatctaatactaatttaaaatttgttagttttattgtgacaacgtcatatttaatttatagaattatgtaaatgataataattgttttttatttttctttttaaaattaattagttatatcaaaatttttgataaaaaaacttgcaattatcatttgtgaatttaaaatgattgccgcaaattatgctttattgcattttatcaatcaaaatggaaaggaattagttatgcttaatcaaataatcataaacaagctgaacgaccaaattaacttagagttctactcttctaatgtttatttacaaatgagtgcatggtgttcaaaacacggttatgagggggctgctaccttcttacttcgtcatgctgatgaagaattagaacatatgcaaaaactgtttaattatgtaagtgaaactagtggtatgcctattttaggaaaaattgatgcacctaaacatgattattcttcattaagagaagtttttgaaataactttagaacatgaaaaattagtcacgtcaaaaatcaatgaattagttgaagttacttttgaaagcaaagactactctacttttaacttcctgcagtggtatgtagcagaacagcatgaagaagaaaaattatttagtggaattattgatagatttaatcttgttggcgaagatggtaaaggattattctttattgatcgtgaactcgcaactttggaatagataggagaaaatagtatgttatcagaaaatgtagtaaaactattaaacgatcaaatgaatttagagttttattcttctaatttatatttacaaatgagtgcttggtgcgatcagcaaggctttgaaggcactgcaaaatttttatcagttcatgctgctgaagaaatgcaacatatgcgtaaattatttacttatttaaatgaaactggctcacttgctgtaatttctgcaattgaagcacctgcacatgaatataaatcattaaaagaagtaattgaaacgacctatgagcatgaaaaattaattaccagtaaaatcaatgaattagtaggtaaaacctttgaagaaaaagactactctgcatttaatttcttacaatggtatgtggaagaacaacatgaagaagaaaaattatttagtagtattttagataaattaaattttcttggagaagatggcaaaggcttgttcctaattgataaggatttaggtaatctctctactaaagcctaattatagattatcaaatctggcagatcttttatttaaaataatgtgtctgccagattattttattccaaattttccaaaaatattttctattgcataattacatctcgtaatcttatttctaatcttatcaaaacatattttgccttatattaagtatattttgagttaatcaaggtattataaaaatgaaaaggatctatactgatgaaccaaccaaccaaccaaccaaccaaccaaccaaccaaccaaccaaccaaccaaccaaccaaccaaaataataaaaccgttgcggtagtgacttcaacaattggtcgtccagaattatctttggctattaaaagcgtacaaaatcaaacttatccatgtaagcattatgtatttattgatggcaatattttctgggataaagccaaatctatattggaatacaaaaagcgatattttcgtagatgttaaaatagaagatattcaacaacaactccattttacttttaatgaagttaatggacatattgatactaattgttacgccgtacctcgtgagattgcacaaaaaacttcatatagttggaacacgtcattaattggtgatcgcagctttttatctgccttaaaaagtttggggttaataggtcaaacttcaggnaaatataccgttaaatatagggcagatttcaataaactaattgctgttcgtcgtgtttttcctcaattatccttgtcagatgaagataacaataatatttctgcaaaaatattagaagtgataaatcagcaaaatatagaatattatggaggtcgcccttgggcaaaggaataaaaaatacaatttttaatcaaaaagtataaaaaataaaaatcaggcttgacttattccttttgcactagtttaatagtacaaaattttccaaaaggataaataaatatgaacattcaaactcaagcctttattgcggtgacagctcaacccattccctattatgctgacaccaccgctatttttaatacactttgtcaatccaattcaaattctcttctactcgactctgccgaaatcggtagtaaaaacagtttacaaagccttatcttagtcaatgctgcggttaaaataacgtgcttaggtcacaacgtcacatttaaagctttaaataataatggaaaacaagttttaaaagaaattcatccaaaattaaccgcacttggaaaagtaagtgcggtcaattttgaagacgaattttctgtacaatttttgccacttgataatcaacttgatgaagatagtaaattacagtctgccactatttttgatgggttgcgtgttatttctagtctttatcaacatagccaaacgcctattttcttaggcggattatttgcttacgatctcgtcgcaaattttattccaatggatggcattacattaaaaaatgatggtatcaactgccctgattacagtttctatcttgccgaacacctcattactatcgaccatcaaaatcaacaagcaacactgaaaagtttctgttttgctcaagaagaacaagttaatattgcgaaaacctccctttccatcgcacaaaaactaaaaaatattgatcacgttctttctattaaagcggcaagtgatgaagttaaaacaaactttgacgatcctgaatttactggtatcgtaaaagccttaaaacaccatattaatattggagatgttttccaaattgtgccttctcgccgtttctcccttgcttgcccgaatacattagccagttacgctcaactcaaacaaaataatccaagcccttatatgttctatatgaacgatgaagactttattttgtttggtgcatcgccagaaagtgcgctgaaatacgcgccagaaaatcgtcagctagaaatttaccctatcgcaggttcacgccctcgtggttttgatgctcacggcaacattgatcctgaattggatgcgcgtttagaactagaacttcgccttgatcataaagaacaagcagaacatttaatgttagttgatttagcgcgtaacgacattgctcgagtttgccaaagtggcacccgtaaagtggcagaattaatgcaagtggatcgctattctcacatcatgcatttagtgtctcgtgtggtgggtaaattacgccctgaattagatgcacttcacgcctatcaagcctgtatgaatatgggcacattaactggtgcgcctaaaattaaagcgatgcagcttatttatcaatttgagcagcaaaaacgccatagttacggtggtgcagtgggttatctcacgtccgatggacattttgatacctgtatcgtgatccgttctgcttttgtacaaaatggaatggcccatgtacaagcaggttgcggcgaagtgttggattctgatccacaaatggaagctgatgaaacacgccacaaagccgcggctgtcttaaaagcaattcgtcaagttaatacacaagcaaaataaggaagaattattatggctaatattttatttttagataacttcgattccttcacttacaatcttgtggatcaatttcgtgtgttgggtcacaacgtcacaatttaccgcaatgactgcgacttagaaaaactggtagaaaccgcactcaatacacctgataccattcttggcactttctccagggccaggaacgccatcagaagctgggattttgctaccattaatcgaacgcttaaaaaatcaagtgccgattattggagtttgtttaggtcatcaagcgttgattcaagcctttggtggtaaggttgttcacgctggcgaagtgttgcatggtaaagtttctcgtatatcccatgataacgaagctatgtttaaagatcttgcaaatccaatgcctgtggcgcgttatcattctttaatgggacaagatttaccaaaagaatttatcgtcaatgcggaatataatggcattataatggcaattcgtcatcgcgatttacccatttgcgcattccaatttcaccctgaaagtattttaactgtgcaaggttcgcaattattacaacaatcaattgaatggttgttaaatagataagacatcaaaaagtgcggtaatttttaaccgcactttaaaggagaaaaaatgatcactgtattcggacttaaatccaaactcgcaccacgtcgtgaaaaactcgcggaagtaatttataacagtcttcatctcggattagacattccaaaaggcaagcatgcgattcgctttttgtgtttagaaaaagaagatttttactacccttttgatcgtagcgatgattacaccgtcatcgaaattaacctgatggctggccgtatggaaggcacaaaaaaacgcttgataaaaatgttgtttagcgaattagagtacaaactcggcattcgagctcacgatgtggaaattacgattaaagaacagcctgcccattgctggggtttccgaggaatgacaggtgatgaggcgcgcgatttagattacgatatttatgtttaataaaatatagaaaattaacaaatccatatacaaagaaaaacaggaatagactatgcaacacaaccaattattagaacaactttatagcggacattcactttcaacctcagaaagcaccgctctttttaatgcagtcatccaaggtgagctttccaatgaacaaattgctgcaatgcttattgctttaaaagtgcggggagcaaatactgaggaaatttcgggtgccgttgccgcctcattacaaaatgccaaagcatttccatatccaaattatccttttgcggatattgtaggaacaggaggcaatggtcaaaacactattaatatttccactaccagtgcgattgttgcggcatcaatgggagcaaaaatagcaaaacatggcaatcgtagcgtgtcgagtaaatcaggtgctagcgatgtgcttaccgcacttagcgttaatgtgaacgtcacaccagagcaagctcgacaagcgttagatgaaattggtgtctgttttttatttgctcaacaatatcattctggtttccgtcatgttgcgccagtccgtgccgctttaaaaacgcgcactatctttaatattttagggccgcttatcaatcctgctcgcccaacttatcatttacttggcgtatatgcgcctgaattagtaaaaacctatgctgaaaccgcagttgccttagaacatcaacattcctttgttgtacatggttctggcttagatgaagtcgcattgcacggcgaaacacaagtggcagaaattaaaaatggcaaaattgaatatttcactttaacgcctgaagattttggcttaaaaacgcaatccctcgaaagtcttcgcggtggtgaaccacaagaaaatgcccaatatctgaccgcacttttacaaggtaaaggaaaagctgaacacgctaatgcggtggcggcaaacacggcattattattgaaattattcggttacgatgatttaaaacaaaatgtgcaaaatgtactggcgcatcttgtatcaggtaaagcctttgaaacattacagaaattaaccacatattaataaaagctaattttatacgccacaataagaagaaaaatgatgatcactcaagattttaccaaacccattgattccgctacggtgctacaaaaaatcgtgcttgataaagcacaatgggttaaagcaaaagaaaaggaatttcccctttcacaatttaaacaaaacattcaaaactctgaccgctctttttatgatgcgttagcaaaaggtacgcatcaaaagcccgcttacattttggaatgtaaaaaagcctccccttctaagggattaattcgtgctgaatttaatttggaagaaatcgccaatgtctataaacattatgcgtccgctgtatctgttctgacagatgaaaaatactttcaagggaattttgaattcttgcctttagttcgcgatatcgtaagccaacctgtgctttgcaaagattttatgattagcgaatatcaagtttaccttgctcgctactatcaagtggatgcaattttattaatgctttctgtggtaaatgatgagacttatcgtgtgctggcagatcttgctcattctcttggtatgggcgtattgacagaaaccagtaatgaagaagaatttgaacgtgcccttgcacttggtgcgaaaattattggtgtcaataatcgtaacttgcacgatttaacagtagatttaaatcgtgttgttgaactcactaaaaaatacgccgactgtattcctgctgatgtacgtattattagcgaatcaggcatttacaatcacaagcaaattcatcaattacaaaaggtggcgcatggtttcttaattgggagtagcttaatgggcaaccaagatttgaataatgcggttcgctcagtgatttttggagaaaataaagtatgcggtttaacgcgcgcgcaagatgtcaaaatcgtttacgaaaacggggcactttacggcggattaatcttcgcagaacattcaaaacgcagtgtgagtttacgccaagcgcaagaattagtaaccgctgcgccacttcgatttgttggtgtttttcagaatcaagaaattgactttatcgtcaaaatagccagccagttgcagctttatgcggtgcaattacatggtgcagaaactgaagcatttattactgcacttcgccagcaactaccaaaaaacacgcaaatctggaaagcgatttcggtcaatactgaagcccaaagtgcggtcgattttacagatgatttgaatgtggatcgttatatttttgatagccaaacagcgaaccaacaaggtggcacgggtaaaacctttgattggtcattaattcctgaaaatcttaaacacaagattattttagctggaggtatctcaccaaataatgtggaacaagccattgcgcaaggttgcttaggtttagatcttaattctggggtggaaagttctgcgggcgtcaaagatcaagaaaaagtgcggttagtttttaataatatttattaattttaataacatagaaatcactaaatttcagcttaaatactaataggagtaaaaatattatgtgtttaggcgttccgatcaaattgtcaaaattgatgaaaattctcttcaacttgccacagtagatgtatgtggcgtacaacgtgaagtaaatatttcactagtctgcacgggaaatccagccgatttacttggcaaatgggtgcttgttcatgtgggctttacaatgagtgttattgatgaagatgaagctaagaaaatccaagaggctctgatcacaatgagccaactcgaacatgaagttggagattttttaggactaaatcaaaaataaaaagtaggcataatgcctactttttatgttttgttacaacgcctcaatcgctttatactgctcttggattttttctaatccagattggtattccgcttgtttttcgcgttctttcgcaataaccgcttcaggtgctttagccacgaaagcttcattgctaagtttgttttcgatgcgtttcacttcgttttgatatttttcaatctctttggttaaacgggcaagctctgcttctttattgataaagccagccattggcacaagcaattcagcattgcccacgagtttcgctaccgcaagtggtgctgtttcgtttgtggctaacacttgaacgttgtctaacttcgccatggcttttaaaagagcggtctgtttttcgagaatttttgcattttctgcacttaaattacggaataacagatctaaacctttacttggtgcgatgttgctttctgcacgaatattacgcaccgcaacgatcacttcttttaaccactcaatttcagcttctgcttctggatcaaagccgctctcttccacttgtgggaaaggttgtaacataatgctgtcagcagtaatgccgacaaatcctttcactttttgccaaatttcttcggtaataaatggaataagcggatgcgctaaacgtaataatttttctaacacgtgaaccaaggtttggcttgccgcacggatttgtgctgcgttgccgtttgcaaatactggtttagttaattctaaataccagtcacagaattggttccaggtaaactcataaatcgcattggcacaaaggtcgaaacgatattggcttaatgagctacggaaagtttccactgtgcgattgaattccgattgaatccaacgatccgctaatgagaattcgatctcgccttggcttaaatctaatttttcatttgttaagacgaaacggcttgcattccataatttgttacagaaattacggtagccctctaaacgtttcatatcccagttaatgtcacgaccgtttgaagccaatgcagctaatgtgaaacgcaatgcatctgtaccgtgagccgcaataccttcagcaaattctttgcgagtcgctttagcaattttttctgctaattgcggctgcatcatgttgccagtacgtttttcaagtaaatcttcaaggctaataccgtcaatcatatcgattgggtcaagcacgttacctttcgatttcgacattttttgaccttgttcatcacggatcaagcctgttacatacacggttttgaatggcacttgtggtttgccgttttcatcttttacgaagtgcatcgtaaacattatcatacgtgcaacccagaagaagatgatatcaaaacctgtgattaacacatccgttgggtggaacattttgagctctttagtttgctctggccaacctaaggtagagaacgtccataagcctgatgagaaccacgtatctaacacgtcttcatcttgtttgagttcaaccgcagaatctaagttatattttgaccgcacttcttcttcgttacgtgcgacataaacattgccttccgcgtcataccacgctggaatgcggtgtccccaccaaagttggcgagaaatacaccaatcttgaatatcacgcatccaagagaagtaaaggttttcgtattgtttcggcacgaattggatttcgccatcttccaccgctttaattgccacatcagcaagtggttttacgcttacataccattggtcagttagcatcggctcaattggcacaccgccacggtcgccataaggcactttcaaatcgtgtggtttaatttcgtctaataaacccagtgcttcaaaatctgcgacaattttcttacgcgcagcaaaacgttctaagccacggtaatccgcaggaatagtcgcttcatagccagcaagtggtttgccgtcagtaccgataatttccgcttcatcacgaatatttgcgttcagcgtcaatacatttaccattggtaaattatgacgtttacccacttcatagtcgttgaaatcgtgtgctggggtgattttcacgacacctgtaccgaattcacgatccacatattcatcggcaataatcggaatttcacggttagccagtggtagaacaacagttttaccaattaaagattggtaacgctcatcttcaggatgtaccgccaccgccgtatcgcccaacatagtttctggacgtgtggttgccaccactaaataatctttaccatctgccgtttttgcatcgtttgctaacggataacggaaatgccaaagggagcctttgctttctttattttcaacttctaaatcagaaattgcggtgtgaagttttggatcccagtttaccaagcgtttgccacggtaaatcaacccttcttcgtgcaaacgaacaaacacttcttttactgcattcgataaaccatcgtccatcgtgaaacgctcacgttcccagtcgattgagttccctaaacggcgcatttgttggctgattgtgccacctgaataggctttccaatcccaaattttattgatgaacgcttcgcgaccataatcgtggcgagttttgccttcttcagccgcaattttacgttccaccaccatttgggtcgcaatacccgcgtggtctgtccccgtttgccataaggtgttatgcccttccatacggttaaaacggattaaggtatccattaaggtttgttggaaagcatgccccatgtgtagagaacctgttacgttcggcggcggaattgcaatgcaatagctcggcgcattttcattttcagacggtttaaaataaccgctctcttcccaacgttgataaagggcttgttctaccgcagacggattaaaacggtctgccatttcgaatttttgtgtcatttattttttctctttattataaaagcagttatttttttctatccctaaacgattaactgcaatattatatattccattatttttttcatatccaatgaaatgtctatttaattctttagctgctaataatgtagtaccactaccagcaaaaggatctaatacaatttgttcttcttttgttactaaatcaataagcaatttcattagattaagtggtttttgagcaacatgataacctttatcctcagaagttattcttacttttagtatattagaatgatttaaagctccttgttgtatattccaatgagttaacgaattttcattccaagctccaacttcatgtttgattaaattatcagctaatgtactgccagttttatatggtttttgaaaccataaaataggctcaaataaaggtcgtaaattagcaactctccaaccaacccatttattagtattagcaatatcacctcgacgttcaaacacacaagaaattctttgtgctctatgtggagctttgtctttttcccaactcaacatatctttgaaagtaaaaccactattttcaaacgcaacaacaactctgtgtgcaaattgtcttcctgnaaaaacaaagactgaacttcctgactttaatactctaaaccattcattagaccaactttcaacccactcttgatactcttgcggtcttttcttatcagcctctgaccaaccatttaatggtttacctcttcgtttaaacaatgatgttttgtgttgagctgaagatgttcctcctaatgcactattagtattggaatgcaatatatcccaatcatcataatcaattccataaggaatatcagagataattgcatgaatagaattactatccaatttttttatttcanaaatagaatcagaattataaatacagtctatcattactttttatccctttaataaaactatcaatagtttctatttttgaagacatatttatatctttcaataatgcttctatggcttcttctcttgtaaaattttttataatatttatttgttttttccaatattccttttctatcaaggatctttcttcaataaaattgatctctttttgaagaagttgatttaaagtatctttatctattttaaataaatccataaagtatttattaaaatctctcataaaattattttcagcatcagatacagatgtttttttactttgctttttgggaaagttccataattgctcaaaagraaaaatattagtttcctctaaatctaactgtaataatatagctaaatgttcccaactaaataacaaaacattttcatctaacgattgcttaaaaatttgacttttagttgtaggatattgaaaaaatggtgctgttaatactgcataatccttatcttctcgccattcacttaacgcttttactttaaaatctttttgatttttagcagtacgactaagtcgaaaagatttagcatcagcaactaagccgtaattaaattctttagagagtgctatcacatctccagcattacctctctgttctaatggttttgagttcagattaagtaattgaaaagctttagctaatacaatatctcctgcttttgagaataatttctcttgtgtagaacttggttttattgcctcaggaagtattccaatagatctaaccaattcaataacctcatttctattcaatttataaataaatgagattaaactattagttgcctgtttaaattcttgattagttaaattttctatcagtgataataatttctctaacgcacttttcttcattaaaatactcctttaagctaaattgaattacccaaaagataatctcattcggataaatcccccgaatcacttctttcaactcatccaaccccatattctcctgcttcgcatgtggttgtgtcagttcatcaagggtaatcggcgacacacttaacacttcaatgttgcagaaatattgattatcttcaaaccgccccacacgtaaaatatcgcctgctttaaaatggctttcggagtcatcccgaatgctaatcgttttatgcccagcgagaatatcggcttcaaaacgttggtaaaaagtgatgtcatttggttgcattttgatccttaaagagcggttaggttttagaaagtttttacaaatcctagatttatcaattgatttaatacttttttacaccagcttggtaaaaattcactaaattgagtaatgcagttatcttttagttgaaaaatcaattcaagcgcaatgccagagttatcataaataaaaatttcatcacaatatgacaaaacaagaaataaattatctaaacttatttaataacgatattttacaatatcttcagcaataaaatgaccaccactttttactctngccttaatccgtgcaagatttatttcaacgcgattaataccaatataatttaaatgtacataaaagccattttctttcgccgttttcattctttgaataattgaattacctgaaagtgtcgattccataggaaaaccaatatgttgcttaatagcaaaatgaaatagccctatcgcttttctgcctgcatcaatatcagcaagtcttggattttgaggattaatctgcattgcaatatgatcagaatcaatcacaatttgcacagcatcttggttaaaagaacgtaaagtactttttcccgaaccatttgttccacaataaaaaatcgctttattttgcataacccacaattttttccgaaccatctggataatgctcgactatcttgccatcagttttttgaaagataaccacctcgtgattcattttctctttcatccaaactgaaaataacgctttaagttgtttctgttgttgaataattttctcacgntcagtcatcaattatcctctttaattaattcaaaacctactgctcaatactcaaaattgaaagcgttgataaaaggtaatatcgntcatttattaacccacgttttcagtagaaagattccaaccttgcagacgtaattgtttataacgttctcgagcttgtgtttttaacgcatcatctttcggcacaaaatcaataatttgggtaaaactatggctaaaatctgggatttcttgttgcaaattgattaacaaatcgcggcgttgtaaatttcgttttccaagccatgaaatctcaatcggtgtgggatattgtgttgcctcacccgataaattatgtggaamaaattcattaggatctcgttgccacaaacgctcgtcaatctctagcgcttgagcctcactttcgcaactaattagtacttttttccctgaacgccatattgaagcagcaagattacaggctatttcttcgacagttaaagtacaattttccgtaagaatataaaattgcgcagtttttgccattttagccccgttattttctcaatcttaccctataaaaagggtaaaattttaacgaaaaaaccctaaaaaataaataattaaatatgcattattacaaatgtctgaaaatccaccgcgcttttatgatctatgtcacaaaactgatttttaacgtttttgttncgttccactcataactcggaagtgttaaaatcacttgcgttttaattttcattcaattcataggagtacagaatggcatttcgtattgaaaaagacacaatgggtgangttcaagttctagcagataaatactgggctgcacaaactgaacgttcacgcaataactttaaaattggcccagccgcatcaatgccacatgaaattatcgaagcttttggctatttgaaaaaagcagccgcatttgctaatcatgatttgggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgtgctcatgtgttaaacggtggaaaattaggtgaaaaatctattattcacccaaatgatgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaataccctcccacatttaagccaattagcattgggtggaactgcggttggcacaggtttgaacacgccgaaagntaatgatttgaaagtggcagattacattgcaaaattcaccgcacttccgtttgtcacagcagataataaatttgangcattagccgctcatgatgcgattgttgaaactcacggtgcattacgtcaattagcaatgagtttatttaaaattgcgaacgatattcgtctattagcatctggccctcgttcgggaattggcgaaattttaattcctgaaaatgaaccaggttcttcaattatgccaggtaaagtaaacccaactcaatgcgaassgatgacaatggtctgtgcacaagtatttggtaacgacaccaccatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgttggtgaccgcacttaatacgcatatcggttatgaaaatgcagctaaaattgcaaaaaccgcacataaaaatggcaccacattacgtgaagaagcgattaatttaggtttagtgtctgccgaagattttgataaatgggttcgcccagaagatatggtgggtagcttaaaataattcatcgcacaaattaacattacaacgatcaaaggcgagtaaaattactcgcctttttactgatttctaatttgctttttgatgcggtttgttataatcaacaaaattttattcacggctatttattatgaaaatgaaatccctttttgtggcaatgataacgtttttttctgccgcaccttttgctcattggcaacccatcggaaatgccgaatacacttgggggccgttccatgtttataccattggtttgttttctgaaactggcacttatcaagaaaatgaacgtccattaatgctctctttcaaatatgaaaaacccattgaaggaaaaaattttgcgattacgctcattaaagaaatcgaaaccttaaaacttaatgatggcgatactcaaagctggcttaaagaaatgcaagcgacctttcctgatttctcaccaaacgatattttgaactatattgccttacccgatagaggctacttcgtcttaaatgatacagttttagaacacgattttgatgctaaatttaatcaagcatttatcggcatttggcttgcaccgaatagtacttttgtaaaacttcagccacaattattaggcaaaacgaaaagcaatcatgaagcgacagagttttatctcaaacctgaaattgaatcctttgatgaacaagattctacacctgaattaccgccaaattatttattagatagtcagaaaaaatctcaaggataaattcagttttttatattttgcaccataaaaaatacctgtttccgaataaattattatcaaggaaacaggtatttattatttgaacattctctatctgactaaaatttttcccaaactgggataacgctatcaactaaatctaaattttttcctaactcaatccagccacaagggaaatgaaaatcggagccaacggatccctgcagatcaaattcttttgcccaacgagcaagcatttgacgctgatcttttgtttgaccacaatccgccatttccattccatcaccgccccaagccttaaaatcgactatcagcttacgcacccatttccccgtcatgttataacgtaatggatgcgcaataatagctataccacctgcggcatggattgtctcaatcgctgtgggaatatcagcccattcagctttaacaaatgccgattttccttgccctaaatagcgtttaaaggcctgaccatcattagataccttaccaatctgcaccaaataacgtgcataatgagcacgcgtcacttcgccatcggctaaggcttttgctccgtcataagcattaggaatccctgctttttctaatttatcgccaatttccaccgctcttttttcccgtaatgctttttgactttgcaaaagtgcggtcatttttggatgagttttatcgaagtttaatcctacaatatggatccctcgcccttcccaatttgtcgaaatttctactccagtaatcaattcaatgcctacttctttcgctgcaatctcagcttcatcaatgcccgcaatcgtatcgtgatcgcataatgccagcacgttcacgccttgcgcataagcacgatgcactaattcggttggactcaacactccatctgatgcggtactatgacaatgtaagtcgtatttttttgtcattatttaatattttttactaattcttttactaattttggaccgtgataaatcaatcctgaataaacttgcaacaactctgcaccagcctcaattttctcttgtgcattttgcaacccatcaatgccaccgctaccaataatgggaatctgacctttcagttcttgatgtaatcgcttaataatctccgtgcttttatgctgcaacggctttccacttaatccgccttgctgttcggcatttttcatccccgtaaccgtatcacgagaaattgtagtattcgttgcaataacgccatccattttatgacgaaccaatgtatccgcaatttgcactaattcactttccgttaaatctggtgcaatttttaccgcaatcggcacatatttattgtattggtttgccaaaatagcctgacgatccttaatgcttcgcaataaatcatcgaaataatcaccatattgtaattgacgcaaatctggtgtattgggagatgaaatattcaccgtaatataacctgcgtagttataggctttgttcaaacagaaaatataatcatctttgccttgttccaaagatgtaaatttattcttaccaatattgatgcctatcacacctttataacgggcgtttttcacattttctataagatagtcaataccattattattaaaaccattacggttaataatgccttcagcttcaatcaaacgaaactgacgtggctttgcattcccatcttgtgcaacgggcgtgacagttcccagttctaaaaaaccaaaacccaatgcaccaaagccgtcaatcgcatcgccatttttatccgctcctgccgccaatccaatgggattagggaaattcacacccattaccgttttcggaaagcctttgggagcatgaataagagattttaagatcggttgaaataaaggattaccagctaatttcaagcattgaatcgtgaaattatgagccttttcagcatccatttggaaaatgccgtgacggaataattgatacatactcgtttatctctcgggatagtttactgtaagaaagtgcggtcaattttcaccgcactttaaaggtaaggttggtcgtattctacgaggaacaaaaatgatgtgcaaataataaagaaataattaatggaaaatattgtaaaattaagctctacacgatcattaatacattttaattatgtataaaaaacggctagttttatttttatggtgcctagggtctttctctttatgttgggaattgccattgttcaatctcctgttcaagtgcggttaattcttcgggggggttaaatgtcagtaagcggtcttcaaatgcttgacgttgcccgataatgatgccaatcacgacggcaaactgagcggatttttcaatcactttttctaccaatatttcaaacggcacaccacgatttcgggcaatttgtgtgagcattgaggtttctgttgaattatccgcctgccacgctaacgcttctttctcttggcggtaaaaactttcaatttccgtttgtggatagcctgccagcaatccatttttaggtagattttttggcgtttgtaggttaaatcgccgttagcgtgcatacgaagtgtgccaatctcttggttgcttaatttatattcgaaccaacaatcgccattgtttgccccgatatttaaatagtctccgcgtgaagcataatgcgggctgtctgaaatacggatatttctttttgccacaatacgattttcaaaggttttctcgccattaatgctttcgttaccatttaaaccaacctttccatctgcggtagttttggcttctactgctttgtcataggcggttttcacggcttttgatgttgcagcttcggtttcgctgtcgctgttagtggctgagcttagttgcacgatcccatattgttgtaacgttgcccgtgcaatttcatttaaggcaaattccccatccacgcaataagtcagggaaattatcaacttcgcctcgttttgcagatgatgcaaaaatgctttcatctggcgtatttactaatgccatatatgacctcttatgttaagttgaaaagatattgcacacctgcttggcgtggcaatatatctaaatgattgattgcgaatttcttaaaatcagatgtgctcgcacttggaacagagatagagacggtcatatcgtagttatcgacaatgtgacaaccttctccgaaaataaataggcatgcctcaattaagtttggtagcgtgcctatttggtagtttttaaggattctgcatttaatcaggaaccgataatcatcatcggataatctgacggaatcagacagcgagtctcgtttacgataccattcacaccgcctagtcttttttggctaaatcccagtgcattgggcgaattgcggaaaccaaaaaatttacgtaattgatagccattaataacccgaaattgcccgacgtgtacctacttcgcctgcacgagcaggcgcttgttcgtaagcataactcatttcattattctcctaactgttgtaagttttgttgaaatctatttttggtgcagctttaggctccgcatcaccaagcaaaatattaccgagtgatttacgttcatccgctaatttcgccacaaccacttttgctgtttgatatgcacccgaaatttcctcatcggataatttggctgcctcatctttagtaaaaatgccctgcgcaactaccgcactttcttggatttcacgcacagtcgcgttatccgcaaaattgacttctttaaatgcagttttagcatcagccaacacggcagcttgttttacttctgcgtcacgttttgcttgtgcatcttttagctgttgaatttcttcatctttagctttaaggcttttttcaagctcttctttttccacgtcatcttcctttttattttcaggttcagattttttttcttttggtttggttggttgttcgccttttggctctttaccttcttcactaccagacttttcttcgtcctcaatttgttttttctgttcgtccgacaacttgatgccgaacgcacctaaaaacgcatcgagaatttttgcggttttccccataatggttttatcctcatcggcaagttttacacttccaccgcagcgaccctttgccacaatcgctacgtggttgccgatcatcggcgacatctcaaaatctgcatcttgtaccgtggatggcttaatatcgcagtcatatccgcaagataattgttccacaccgtgctcctgtacggttttaatggcttgttcatcataaatccaagcctcggctgtgagttcatcgcccactcgcttaacattacgcacgacaccgacagaaagctgtttccagtttttcgcattcaccccatctttaagatgaccaacggttaatgttgcattttcaaaactcttaatcgtttcatcgctaaacaaagatttctcggtgcgagcaacttttttaataccgtcttcttttagcccaagttctgtagcgaggtaatcaaataccccaactttagaaatggttgcgggcacaactaaaaaaccatctttagtgatggttctttgtgtgtctgcttgagtagttttgtctgtaaatttcatttatttaccccaataaaaaacccgaccatttctgatcgggttatttgtttttttgcaatatcacgccaacatttggctaattattgtttgtgctacttgttttatcgcatcaagtgataaatcaaggcttttgctttttatcgtagtttttaagctattccagacagtatcgttgcggattttgtctaagagttcatgaccttgccaagtcagcaaccgagcgataagactcatctcatttagagaagaataatctatcgcttcaatcagccctgcactttgcaataacttaaaatgataagatacagtttctgaatcgaaaccagtaaatccatcaggtaataaactccctctagcctctgactgactttccaatttaagcaatatagagcgaattaaatcccaattacgtttcattctttgttatctcttggccaaagcatatccacaatctcatcataagatgatgtttaggctgtttaacatttgaactaatagtggtaaaataagctaaaccgtagattgagcttgggaacgttttggacgtatgcggatgcgagttaataaactaggaattacgcaccaaactattctgcggttatttttttgatttccgcctataaacaacccaatcgaaatgattgggttgtttgaatggctgaatttaatttagagccatcatttgatggtaagcattacgcttgctttctcgcaaggattgtatttctgacttcgtcaggtgtcttacgtgaattaatgatgaatcttgcttcccattctgtaaaccgcgagaagtcgtagccaaattcttttttccaccaactttcaagttcgccatatttactccgtaattctgctaatgtgtgtttagatagccttaattgtacagaatattgtttgccggttaaagcataagatgcaataacttttcctttattatatagccttttagactagccaatgtaccgccttgtgtttgtgtgtcatctaaaataatagcatatttatcttttggaactatgccatcaaaagctggagaataaaccaatcgatgccatccatctcccccagttctagatacttttgttgcttgaacaattgataaatcaacaggaatatggagttttttagataatacagtagcaatagctacaggaatcatattttgaccaacggcttcttctgcatgaacaggaattagaattgcatttttattgccaaccaattgcttcaatttatttaccgcatcatctgtaactaaatctttagcaagttgataagcatcttcaatactaccctttttagcattttcatatagcggatgtgatgttgcatctcctaatttcctatcaatgatagtatcagggaaatcatcagaccattctgagcgcatttgttgtttttcctgttggctaactattgggctatttttcactatctgctcgttattatcaagcactggaatctgaacacaccgacaattaaaatcatgaccaggatgatcagtatcagcaggcggattggcatattcaaatatctgcccatctttttccgcatggctttcgcgtacacgctcatcaagcgatgctgaccacatatatttttttatgccaacctcttcatgtctcgcttgcgttaaggcggcatttaattttgaggactggtctcgcgcaataaacattgctcgtttttcggttgttttacccaagtcttttatttgtgctgcaaggtctttatttaaagaacctcgaaccattgcttgcatgacggcattttgcactttatcaagatattgtgagcgaatagacttaattaactggatattaccagcggtcaatgcattcactttctcagtaatatttggactattgcgtaaataggcggataaatcgatgccagtttgattttttagattggttgatacttcagcatggttttgcgcatcaccacgactaacaaagccattggcgatattttcggcctgtgaagtgcggtctgatttttcgtacttttctaatactttcatcagtgctttcgcactaatcgcttgaaatccttttgcatcatccataaaaaaagagccttgcggttgttgcagggctctttctacatcattggtcatcattttgacgaactgcttaagctgttgtctataccaaagctccgttctcttactcatcttcactggcttgaacttgcgtgctctcgccttctggttcttcaaaatttctggcaagttcattagcatttttcatttcctcaatgtcatcagcagagatattggcaaataaaccactttctcggagttcgtttgctacttgatattcatttactacgccattttgaattaacgtatttgccgctgtagcaaaggtattaagcatattgacttgttgttcttgtttaaccaccgtcaatggtaaaaactcaaaccaccagtcatcaggttgcccaccaaataattcattgcatagcagtgtatcaagcacntcaagcacaggacgcaatcttgtttcttgcaatcgatgaatggattcgtggtagttttgaatatcctcatctccacttgccaatcccgaaacagattgcccaaacaaaatggtgactggcatatctgccgcacctgccaccgcattgcgaaactctgtcaataaatcttttaacccaccaaaagataattcttttcggtcgtactcattttccgcatcaagcaacagactattggttgctgatttaatcgactgcaccgctgaaataacgtgagccacatcattttctaagccagctgaaatcttgtcagataaccctgcaattttgaaaatatcgattttactttcaaaaataaggtcgccgacattcgctgaggcactatcaaagcgtttaagtacatcaataatcttttcaaggtctgatacaccccaaatatcgttatcagataatggcgcatcattggcattgatgattaataagcgtgaatgatgcactgaaacagattgtgtgccgccagtaatggtatattcactgtatcgaccaaagtttggcgaaaatacatcgtcatctcgttgtcctgtcggtgagattttccatttaggtaagataattaatcgttttaatcgttctgtaggctgcaatggcgaagtgatgttaattgtgtcagtgacaaccaataaacccaccgccccatacaaactagaccattgcaacgctttagttaatgtctcacgcagttttaatctacgttcaagcttagtgaactcgtctagctgttcagatttcaagtcattcgagaaaatatcacgccaattacgcaccatatcttccgaacgtttaatacaaaccttatttgcaatccagttatcacgccataatgcttcgatttgcattaagtcatcggttaaactaagcccacgagcataatatgtctggtcttgtttgctacctaactttagcgcaagtgatttgatgccatctaaaatattcatcttataaatccagtagtgatttaggttttgtcggggcgtagcacataactaaagcatccgccatatttggagaaggtatgccacgttttttcatatcctttttgctttcaacctttacccgcccgttattgtcataatcaacacgaggacgtgataattctgctttcaaatactcaagctctttgattttgctcgataggcttatcagttcatcgtcaggataaacatccccatactttactgctcgataggttttatagaatctatctctcaacgcccaccaagattgggctttaatgttcgaaaacatatcttgattcttttttcctttgatatattcacgctcgggataagcaactgcaccaccagcattaaatccttccacttgtaaagattttggcaagcgtttaaagtgagcttttactcccgcccccacgccaatactatcgaatataatcaaatcagctttaaatttgaccgcactttgatttgttcggttggcggaatcaatcacatcgccatttttccaaacttcaatgtcaagcaccacagaaccgtgaacaaatgcattagcgttactatccgcaccctcatcagccacatcaaagccaactttcttcattcctttagcggtaaaaccgagcttgagatgcgcatctaccgcatattcaatccatacaggcttaataatcgccaaatcactgtctgcaacaggctcgccctcataaacgtgacgataaagctcgtaatcacgctcacgcatctgctccatatcttccattaattctttcggaaaatatgggttgtcttgccaattcactaagaccgatttacaccgctcaggcggatgaatcacaaaacgttgataggtgtcatcaagaatattcttcgggttaaagctcacaataatctgcgaaccgtcttcacgaatggttggaatcaatatatcccaactttcttttgaaacattctcgccttcttctacccaaactacatcaatgcctgtcatcgacttaatcgaagtaatgttagttttcagccccgcaaacgtgaagcgtgaaccgttttgcccgataatttgcgttttctgaacatcaaaaaaggcttgcaagctaagcatttcaatctgatctgccaacatctgaatcacagaatcagaaatcgatttctgaatttcacggaacacaaaactcgaacaggcgattgataggctcgcaatactaatgctctagcgatactaaaacttttacctgaacctcgcccaccgtagaaaataataaaccgccaaatagattcaaagagcggtttgaattttgtcggaaattgaatattaagctggctcatcgctaaatgtcacattaatcacagtaggtaagggcttgccatcagttgttacatcaactttattggtaaacatccctaaatgcttcccaagcaattcaagggctttatttgcacctgtcggttcaaaaacgaaacattcggtattaacgctttgtgccgttccttcttgagcattttttaccacagtggtaatagtaagtggctttcttcccatacaaatatcacgatactcttgcaagtccgcaatgatattatctagggtaagattatggcgttgttgatgggcttgtcttagttcttcaacccttaccgtaatcttaccgttcttattaagtaactcacttgccttaacattgataacttcagttgtcatttttgagcaatcataactctgccgatatgcttcactggcattccccagctcaatataaagctggcaaaatttttcttgtttaggtgttaatccacgaccagacgtagattttcctttcacgtctgacataggaaatccttacttaataggcagttcaatctgcatcttatcttcaaaaagttttaaagttgcttctagcacaggcttatcgcccttccattccctcaaccctttaccacataaactcgcaaatgctttcttcgctttatgctcaatgcacaattcgttatatttatgcatcaagctataaccttcttgctgtaatttctcacgcataaaatcaaaggctttaataaactctactttgaatttcattgctttttgggttctatatcccattaccaaaagcaaaaatccatttttagtcatttgatacatgggttgttttctgccccattcatcgaaatatgaggtctcctcaaaattgaggagagcaaactcaccgcaatcttgttcaataactaatgctttgatatcacggatgatgttatcgtgacgtttaccaaacaccgtggcaatatgccgagaatttgtcacaatacgttgcttgtcatttacctttaagaattgttcaaagttttcaattgtttgtaggttcattttggacttccattaaattttagataataaaaaacccgaccatttctgatcgggttatttagtcctaacaaaactacctagaaggcttggtttctaccaatttaaagatgttagacattagtcgtggttatttaccgccttttgcttgattaatccacttattaagatgatctacttggcttgcgcacttatctcgctctgcggttaccttaactaactgtatgactacatcgccgtatgtttccccagtaaatgctgttttgacacaaggtgcagtataggcttgaggcggataaatatattctggtttagtcgtgattttattcgtgcaagcggtcaagaacagactgaggcaaacgagtgtgagcacaaggttgagtcttaatgattgttttaactgattcagcattttctgttgctatcctttctatttcatcattacgctcttgttgtaacgcaagacttaatgatttgttagtatcttcttgttgctttgtcgttatttccaactcatctataacgctagattggtaacgcaatgcaccaaacaaaaccacgacaacacccactaacgctatgtaaatgtacttagtcattatccgttaccattaatgctcgatagagcttgcaacgctcatcaatgccatttagtccaccattaattcttcgcgtgactttttcgacagaattaagctcagccaactcatagcacttccaataccacactgcagttttaacagataaatctaaattccctgccacatcttctggctcaatatctctacctaaccattttctaaatgcggcataattatccttacctgtaatctgaatcagtccacgaccacgatacttccaaccatctccacttttctcatcgccattacccaaacgattagcataaatacgattggctattagctcaggtttgcgctcatatttcttcgctgtaagagggtctgggaaatatttacggaaagtttgagaaagcccaagccaagaataatttaaattttctttaaatcttataaatccgccactttcatgtccacattgagccaaaaacatcgcttgctgcatcttattcacacaacctgctttttctatctgcgccgaaatagcttgataaacacctttaactgcgtgtggaaaaattttattaaatgtcacttcggaaatcatcattgtcatctttttcaattctccgattaatgaatttaaataaaaactcgcgaattttttcagtaccaacaaaaccaatcatcgtaccgagaaatgaagaatattctgtatgcccaaataaatgcgtacaaattggcaccgcaacacccgcaatagaggcacacatagccgcatcaattaaaacataacgaatagctggctttttacgcataaacccaaatcttaaaagagaaataaataacgcccaaaaagcactctgtgctgagctagaactaagatttgtttgcaaccaagaccatattaacgcccacacatcaggctctttaattggcatatattttctcccgcctgttctttaggcaataaaaaagccccgaccgtttccgatcagggctgtaaaattctttcttgcgtttgctatgcgctaaaaccgcaatatagtacatataatacacttttagtgtgcactgtcaagcggtttatgaagtgcgctaattagtgatgacgtgtcgcaaatatacccatcgcaatcttggtttaaattgagttcgtatgctgcccataacaacgccaccgcaaagagaattctgaacataatttatcctttttcgtgaatttgaggtgtaaaaatccgccacacggtaaagtgcggtcggattttccgttgtttttagaagtcgattttgactgcttttggattaaagcctcgcaagtgttttaatacacgccaatttgtcattgggtcgatgttaaactcttgtgtaatacggtttaagatttggtttgttgagcgtagacgcttaaatattcgtaagcctgtccatatatatctccgctcatatttgagcctagcgccttaaaggctttttcgatatgttggaatgtgacgatgccacgcatgaaagcgaaccacaaccaaacaagctgttgaagttcatactcggtaaattcaaaactgaatttcttttcgggttctggcaaggcgagctgttgcggttgaagttgatattttcctgttttacgaatttgcgggagaacttcttcaaatacccacgcctcgaatggttcggcttctggtttacgggatttgatgatcagacggtaaagatttggttcgttgatgaatgtcatttcctgatctgcactttttgtaggggtgtaacgtttcgttacgcccccttgtttgcaatgatcttgtaatgcttttcttgaatttgtatatccgagaatgtggcaaacatccgtaccacaaaaccaaaattcaccttttggatctaaaatcacgcgaacaggaagatctttaaaattaaatgttgagaattgaatttgatttttcattgtgtatttcctttttgagaggattgataatttacccataattgggcgaccaacggctcaaaaccagtacacaatctggcggagttattccctttcggtattgtattcctcgcaccgtcggtcattgattctttgagaattttataatggcggtaaaactctcaaattttagatacaaaaaaatcacgctgacggggtgaatgaattccgttgtgtaaaaggtttttgagaccttgaataaaatagtagaggaaaatttggagaatgtaaagcatgaaaattatattttattgtgaaccatacttgacaccctgcgaaaattatctaaaataacgtcaaagcaatcgataaggattaataatgacaatccaaatcaaaaccactctgacatttgattcttggttaagcaaactaaaaaacttgcgtgccaaagcgaaaataaacgcacgaattaaacgcttacagttcggcaactttggtgatatcaaaagcgtgaatgatgggatttttgaattacggattgatgaaggtcaaggttatcgagtttatcttaaaaaccagaatggcgtattagtgattttactttgtggcggagataaatccacacaagataaagatattaaacaagcaaaacttctcgcacaggagctaggattatgactgaacaattaaaagactttgatgtggcagaacacctcacttctgaagaagaaattcaactttaccttaatgaaattctacaagaagataatattgagcttattttatccgcccttggcgacatagcccgtgcgcgtaacatgagccaaatcgcacgtgatgcaggaataagccgagaaggtctttataaagccttatctggcacgggcaatcctacttttgctactgtaatgaaagtaatgaaagccttaaatttacaattccaagtgcaacaatctcgattcgcctaaaagaaatgcggtcaaaatcgaccgcacttttcaggcaataaataaatattgcttgccttctgttgataatagcaataaaagtgatgtttttaccgttttcaatcgattgaaatattcacgccgtgaaatatgtaaatatcgccaaattccttgtttttcccatctcttgatataagtcagaacgaatacatcataaagttctggtgtgacttttctaattacaccaaggtagccatcaatttccatgcctaattcatcgcttataggacgcatacgatatttttcagcataacgagcatcacatttcatctctgcaaaccctgcggctacacgtggaaattcagtctcgaaagatccgccgttttgctctaagtacggtactgcgaatcctattcagttcatcaccaactattcgcagtggttcgtgatgagttttaaaacttaacttagaatacatcacaatgacacacttaaacttaattcctgtttttaatggcttaatccaaaatcaacccgttcaactttgcaacgctcgtgaacttcacgcattcgtagaaagcaaacagcaatacactgattggatcaaaaaccgcatcaacgaatatggcttcatccaagatgaagactacctcgtcattaccgaacgcaccaacggacgcccacgcaaggaatatcacatcaccctcgatatgggcaaagaactcggtatggtcgaaagaaacgaacgaggcagacaaatccgccaatatttcatccgttgcgaaagaacattaaaagccttgcaacaaccgcaacaacttgccttgccagaacctgagaaattcacgcacgaattcaccgaatttgaaatagaaacgctcgtttggctccttatcggacatcaccaaatgaacaccctactcggacaactcgaaaagccacttgacgccatcggcagcaatctacaccccgctgtgtacagctactggaaagaatatggccgccaatacaaagatgcactcccaaccattaaacgcttaatggcacccttcaaataatcaaaccgtttgaattgggcacgtgcacaacaccttataaaccaataaaacaccacaaaatccgaccgcactttttttactgcggcggattatcacacttaaaatccgataaaaggaacagaaaatgaacaaattaatcattacgctcgtgtgtgcatttgtagtgtatatggtgcacgccctaaatcttaatcaagactgtgacggcaaaatctgtcacaccgaacagacacaacaatattaacaaaccaccgctcttatgggcggttttttattggaggaaatatggaatcaattaaactttcgcagaaagccgaagaagaaattgtgaatgcggcaagaatggcagcgttatccaatttgactgaaaaaagccaaaatttaattacgcttgaggatatcgcaatatattttgggcgacactatcaaaccgttgccaagattatttcaaaactgcctaatttcccaaaacccgttacacccgttacagtcgatcaacaaaattctcgcccacgctatatcgcaggcgaagttgttcgttgggggcggatcaatgctaaaccgtattagctaatcaagtaattccgccacctccgccatatcaggggcataatagacattttgtaaaatcgaaatatctttatgcccagatattttggctaatgtcatcacatctacttttttagatagcctagttaatgcctcacgccgcgtatcgtggaaatgcaaatattctcgctcggcaagttttttgagttttcggaatgttgcatcaagcacactagacttaatatcaaaacacaatccagcatcccctatctcgacttttaaccgttctaaaatagcgattgcatttttagtcaatggcacggttcttgatgtaccgttttttgtcataggcaaaaatgcagtacgtttctcaaaatttacattaccccaactaagactacaaatcttccctgctctcattgcggtttcaacagcaaacaatattgccgcagccgttctcgcttttgcagttttgagcgtatcaacatattcactgatagccacaatagcattaatattttcttccgttactcgctgagttcgaggtttccctttttcgggtaattgtatgccgaccatagggcttttttgtatatacccccatcgctcaagggcaattttgaatatatgacctatcgtagataattcacggcgcacactttcactttttactgattccaatcgctccgcaatccaatcctcaatatctctccgactaacatcagatatatatttatccgtaactggatggcgcaaaaagcgattcagccgattaaattcgtgcttttctccacgctttgttggcgtaattttgttcaaataccgcttaataacatcagaaaataatgtatcaggttgcaatccttgtgcttgcaattctattttcttttcctcttccgcaccccatttcatgttgcattggcgtaatcgatgcataaaaatacttaaaaaatggcaatatttgaggttggaattaatgaggggtttatggctgatgtgaacgtaacgtattgattttactggttgaaatgcataaaagaaaaaaacctgaccaacggtcaagggtttgtatgtggtgcctagggtcggactcgaaccgacacgtttattcaacggcggattttgaatccgctgcgtctaccaatttcgccacccaggcttaatggggttgaattatacgtatatataacaatgtgacaagcaaaatttattggaaataattcatttgttttaaaaataagcaagaattttctgttttctaaaaatatcgccaaacaaatgcaataattaaaatgcacaacataattaaaatttgagctaaacgtttttttgttaatttttcagctgccataatgctttactcttcttaatctgactaaactaattagtggtagaatatttgcgttagatcaattttacactatttttttcaatatttgaggcgtacatgaaaaatttcgttgcaggagctcaatcagggcgcaaaattcaatcaggcggttgtgcgattcattgtcaggattgcagtattagtcagctttgtattccttttaccttaaatgaacaagaattagatcagcttgataatatcatagagagaaaaaaaccgattcaaaagtctcaagtattatttaaagcaggagattctctcaattcaatttatgctattcgttctggcacaataaaaagctatacgattagtgaatctggcgaagaacaaattacttcatttcatttgcccggtgacctagttggttttgatgccattactcaaatgcaacaccctagttttgcacaagctctagaaacggctatggtatgtgaaattccttttgatattttagatgatttggcaggaaaaatgccaaaactacgccagcaaattttacgtttgatgagcagtgaaattaaaagtgatcaagagatgattttattgctatctaaaatgaatgcagaagaacgtttggctgcttttattcataatctttctaaacgctattctgctcgaggtttttcagcaagagaatttcgtttaacaatgacacgtggcgatattggtaattatctaggtttaacagtagaaaccatcagccgcttattaggccgctttcaaaaactcggcgtgattagcgtacaaggcaaatatattacaatcaatgatttaaatggtttaattgaattaactggtacgaataaaacaaaaattacattagttaaataaatttaagcgtgaatatcacgcctttttgtgcttgataaaaataaatttatccaaattaatcttgtaccttgccatttttgctattcttttttatcctatgcctcaattttggaggctattatgaaatttaaaaatattctcgttgtacttaatcccagtaatgaaaaacagtacgccctagctcgtgcagtgcgtttagttgaagaacaaaaaaatgaaactaaggtaaaaatcaccgcacttttatcagtctatgatttatcttatgaaatgtcagctttactttcttccgaagaacgttcagaaatgcatcaacaagtaattgaaaaacaccgtcacgctgttcaatattacttagataaatatgcaaatccagaaattgaattacaatctcatattgtgtggaatagcaatgaagctgatgcaattaacgaagaagtagaaaataataattacgatctcgtcgtaaaatataccaaagacgaagaaaaacttacgtctctaatctttactcccattgattggcaacttcttcgtaaatgccctattcctgtcttaatggttcgtgatggcgattggaaacatccacgccgtattcttgtggctgttaatgtatctggagagcaagaatatcaagatgaatttaatcaagagctggtagaaactggtatttcactcgcggaaaatctaaatcgtggtaatgtccatttggtggcagcctacccttccgcgccaatcaatatggcgattgatttgcctgaatttaatacttcaggttatgaaaacggtattcgaggtcagcatctcattaatatgaaagcgttacgtcagaagtttgggattgatgaagatcatactcacgtacgcgaaggtttcccagaggaagttattcctgaagtggcgaaagaaattgaagctgaattagtgattttaggcacagtgggacgcacaggtttatctgccgcattattaggcaatactgcagnacatgtaattagtaaattaagttgtaatttattaggcattaaaccatcgaaaaaagacgattaaaacattttcctcaatttataagacgccctaaatattttgtatttagggcgtttttatactatttcttatggtatttttcattttgtgatctcgatcacaaatcttaaaattttatttaaatagctatttaaatgatagctattttcatttagtattttgcactcattttttaactcccccattcttattaaggaaatatatgaaaaagacattaattacaagcttattggttttatctggcatagcacaagctcacgaagtttgggttcaagcaccgacgaaattagcatcaggttctgtattaaaagcagaattagcttatggggattacccttatgtagaaaaaattcctgaagcacgcttaaaaatttttgcgccaatggaaattattcatcaaaatggagaaaaacaaaccttaatccaaaaaggcgaaaactatcaatatcaatcagagaaagcactgtctgatggttcttattgggtaacagccacttataaaccaacattttggtcacaaaatgctgaaggttggaaaatggataatttgaaaggattagaaaacccaacttattgcgaacaaactcaaatgtttggcaaaagtctcgttaccgttggtaaaaaaccattaaatgcagaaatggcaatgacaagagttggtttaccgctagaaattgttcctttgcgtgatccaagcaaagcgaaatcaggcgaaccgttccctgttcaaattttctaccaagatcagccattagcaggcgaaactgtcattgcaacagctgatactattatcgtgaaagatcttgaagcaagtacaggtcatcgtgaaccacaaggtttttcaggtaaaacagatagtcaaggacgtgtgaatatcattccattaattgatggaatttggaaaattaaagttattcataaaacaccatttgcagatcaacaaatttgtcagcaatctgcaagctatagcacattaattttaccggttggtaaaggattagctaaactacctccaaaaccagaacaccatcatcactaattttaaaagtgcggtaaaatttcaccgcactttttacatcctaattaaataaaaaatacagaaatagtctgtctaaattctaagttattcatttgcatatccagattttggcagagctttcccatctaaatatgccaaattatctttaagtcttaaccgcccttcggtaaaccatttaatcacaagcggataaatttgatattcttgctcacgggttctagcctccacttcttcgatgctatcttcagggaagattggcacttttgcttgtaagacaatcgcaccaccatctacttcttcattgacaaaatgaacggttgtgccgtgttcattgtcgcctgcttcaatcgcacgttggtaggtgtttaagcctgcgtatttaggaagaagagaaggatggatatttaaaattttccctgcaaaacgttgggtaaattttggggtaagaattttcatataaccagcaaggacgatcaaatctacagctaggctttgcaaataatcgccaattgcgtcgtccatttcaaggttattggaaaaatttttgcgaagaaagaccgcttgcggaatctgtgcttgtttggctcgaactaagccgtaagcatctgctttgttacttatcacacaagcaattttggcgggaatatcgcctgaatggcaggcatcaataatagtttgtaaatttgttccttgaccagaaataaggacggcaatttttttcattttcttccttatagaaatcagcccaaaagggctgaatttaaatttaagattttattattgaatctcaacctgtgcctcgctttcgccaagatgttcaattttgccgataacccacgctttttcgcccgattgttcaagcaatgcaagagcggtttcaacctctttttctggtaatgcaattaccatacctacgccacagttaaaggtgcgatacatttcataacggctgatattgcctttttcttgtaaccagttgaagatcgcaggccattgccagcttgattcatcaatcactgctttagtattgtcaggtaatacacgcgggatattttcccagaaaccaccacctgttaagtgagcaatggcgtgaacttcggtctgcttgatcaactgtaaaatcgattttacatagattttggttggggctaaaagatgctcgctaagcggtttgccttctaataaatccgttggatttgcaccacttacttcaagcactttgcgaattaacgaataaccgtttgagtgtgcaccgcttgagccgagtgcgataagcgtgtcgcctgttttcactgctgtgccgtcaataatctctgatttttcaaccacgcctacgcagaaacccgccaaatcatagtccccttcgtgatacattcctggcatttcggcggtttcgccacccactaacgcacagccagacatttcacaaccatctgcaatacctttgatcacacttgctgccacatcaacgtctaatttccctgtagcatagtaatctaagaagaaaagcggttctgccccttgtacgattaagtcgtttacacacattgccactaaatcttgaccgatggtatcgtgttttttcaagtcaatcgcaagtcgtaattttgtgccaacgccatctgtaccagaaactaaaattggctctttatatttggtgggtaaagcacataatgcgccgaaaccacccaatccgcccataacttcagagcggcgagtgcgttttacatcgcctttgatacgttcgactaattcatttccagtgtgaatatcgacgccagcatctttatagctcagttgtgtgttgctcacgattaacctcgatcaattgaaataaaaattgggcagattatatcatcaagcaaacgtttgcgatattgttaaattaattcatttaatgacatttttaaaattaaaatgaaattgcttgcaatcaaaatttatttgtactactttaatagtacaaataagctcaagatttaggagaaaaaatgaaaactactactgcattagtaacaggtgcaaccgcaggctttggcttggcaatctgtaaaaaattgatcgaagcaggctataaagtgattggcacgggcagacgtgcagatcgattagcagaaatccattcacaattgggcaataattttctaccgcttgcctttgacattcgtgatgaacaagccacaattaacgctctaaatacccttcctgaaggctggcaagcggtcgatttattagtgaataatgcaggtttagccttgggattagagccggcacataaagcggatttacaagattggtatcagatgattgataccaacatcaaaggattggttactatcactcgccttgtgttgccaaatatggtggctcgtaattacgggcagattatcaatttgagttcaattgcaggtacttatccttatgcaggcagtaatgtatatggtggaactaaagcttttgtcacacaatttagcttaaatttacgagccgatctggcaggcacaaaaattcgagtaagcaatgttgaaccgggtttatgtggcggtacggagttctctaatgtgcgttttcacggcgatgatgaaagagccgcaaaagtctatgaaaacgtgcaatcggttcagcctgaagatattgcgaacattgtattatggcttcatcaacaacctgaacacgtgaacattaatcgtattgaagtaatgccaaccgctcaatcttttgcaggaatgagcgtttcaaaagaaaaataaaataataggaaaaaatatgtcagacacacttcttaacccttattttggcgaatttggcggaatgtatgtacccgaaattttagtgcctgttttaaagcaattagaacaagcctttgtggaggctcaaaatgatcctacattccaagcagaatttgctgatttactcaaaaattatgcgggcagaccgaccgcacttactctttgtcgtaacttaaccaaaggtacaaaaactaaactttatcttaaacgtgaagatttattacacggtggtgcacacaaaacaaaccaagtgttagggcaaattttattggctaaacgtatgggcaaaacgcgtattattgccgaaacaggtgcagggcaacacggcgtggcaacagccctagcttgtgctatgttagatatgccgtgccgtgtttatatgggggcaaaagatgttgagcgtcaatcaccaaacgtgttccgtatgcgtttaatgggcgcggaagtgattcctgtacaaaaaggctcttgttctttaaaagatgcctgttgtgaagcgatgcgtgattggtcagcaaattatgaaaccacccattatttacttggaaccgctgcaggccctcaccccttcccgacgattgtgagagaatttcaaaaaatgattggcgaagaaaccaaacgtcaaattctcgaacgggaaggtcgtttacctgatacagtcattgctgctgttggcggtggctcgaatgcaattggtatgtttgctgattttattgatgaatcaaatgtgcgtttaattggtgttgagcctgcgggtaaaggtattgaaacgggcgaacacggtgcaccgctcaagcacggcacaacaggcatctacttcggaatgaaatcgccaattatgcaagataaagatggacaaattgaggaatcctattccatttctgcagggttagattttccctctgtcgggccgcaacatgcttatttaaatgagattggtcgtgctgattatgtatcgattaccgatgaagaagctctcaacgcattccaagaattggcaaaacatgaaggcattatccctgcattagaaagctcacacgccttggcttatgccttgaaattgattaaacaaaatcctgaaaaagaacaacttttagtggttaatctttcaggacgaggcgataaagatatttttaccgttgataaaattttaaatggaggagcaaactaatgagccgttttgaaacgcaatttgcgacacttaacgcaaaaaatgaaggggccttcgtgccgttcgttaccctttgcgaccctactttcgaccgctcttttgagatcatttgcacacttgtggataacggtgcagatgctttagaactcggttttcctttttccgatccgctactcgatggcccagttattcaagccgcgaataatcgtgctttaactgcaggtcatagcagcgaagatagcttgaaactattggaaaaagtgcggtcaaaatatccagagattccgattagcttattactttgtgccaatttaatttttgctaaaggtttagatgctttttatcaacgttgtgcagaagttggtgttgatgctgtacttgtagcagatattccgttactggcaaaaggagattatgtacaaacagctaaaaaacacggtattcaacccgtctttatttgcccaccaaatgcggacgagaaaacgatccaaggcgtagcgaaaaatagcgaaggctatacctatttagtctcacgtgcaggcgtaaccagtgctgaaaatcaagctcacgcagcaaatttagatacccttgtagaaaagcttaaagcccacaatgccccaccaattttacaaggcttcggcattgctcaaccagagcaagttaaagaagcgttgtctttgggcactgcgggtgcaatttcaggttcggcaacggtgaaaattattgagcgaaatttagataatcacgagcaatgtttagctgaattagctgaatttgttcaaacgatgaaagctgcaacaaaataagcaaaaaagaacccgcacttgtggcgggtttcttttatcgagaaaattaaaaatttaatactttcagcttccatccaccataaggggctgaatggattataaatagaatattttgcatgttattctccttaatttcattaataaccttgctgataaattccttccaacaatttcactgaaagtaaggcgagattaaagcgttgttcatctgccacagaccaaaattctacgccattttctaccgcacttatttgacttaaatgaagttttactgattcttcgccattttcttgttctccattaagcacaggcgtaattaaggtttcttctaaagcgataagctcgctattttgaggctgatagtcgaaatcataatctgaaagtgcggtgactttttgtgccaatccataaaatacaggtacttggattgcatgaaatgtagcacgatctaattgcggaaaaattcgttgtaattgattcgataaattaggtgtttgatacggataaacatcaaaggctaagcgcgtttcttcttcatccaatggaataccatttaataaacgggctgtttgtcccgcaagtttagtcacggtttccgcatccgtataagaagccggcaataaagaggtgacaaacacttgattaagattcgtttcttgtaaaatcggggcaagcgttaaagcaagttggcttacttgtggatcaggcaagctaacaatgttacgttgtctcaattcaagtaattgtgattcatttaccgttggaacaacaacaggcacatccgaaagtgcactgcaaacgcctaacatatcaatgacaatacagccctgctctgctgcttgcgcaatatgggaaacttgctcaagttttcctgcaaaaaagacataattaaaatcagcccactctacttcatttggcgaaagttgttcaacgcctttatttcgaaaacgaatattttgttcttcttcaaaaggtattatttcaacaatagaaactttgctaatttcaagcgcactttgttctaaacgctctacaattttttcacttaattcaaattctgctgctatcgcaatatttaaggttgcgtccatttttctctccgctgtaaaataatcagcattattttacaccaaaaccaggaacgaaataatgacacccgcaattgatttacttaaaaaacaaaaaattccttttatcttgcacacttatgatcatgatccgaataatcaacattttggtgatgaggcagccgaaaaattaggcattgatcctaaccgctcttttaaaaccttacttgtggcggaaaatggcgatcagaaaaaacttgcttgttttgtgcttgcaacggccaatatgctgaatttaaagaaagcagcaaaatctatcggtgtgaaaaaagtggaaatggcggataaagatgcagcacaaaaaagtacaggctatcttgtaggtggaattagcccgctaggtcaaaagaaacgcgtgaaaaccgtgataaaatcaaccgcacttgagtttgaaacgatttatgtttcaggcggaaaacgtgggctaagcgtagaaattgcgccacaagatttagcnaaagtattaggtgcagaatttactgatattgttgatgaataagtgatggacttataaatttaaaggcggatttattatttaatacgaactaaaaggactaagctttttttaatcacaaagcttagtccnttactgactttctaacttttaattcttgtcttttaagttaggattaatagnaaaaatttagggtatttattattcttgagtatccgcaattgggattatttttgtggcgtgagatcctttatcgctgtggagaacttcaaattgtactttttgacccgcttttaatgaacgatagccgtccatttcaatcactgaataatgtgcaaaaatatcggcatctacaccttctgcggaaatgaaaccaaatccttttgcattattgaaccattttacaataccaatttccatnaaagncctctctaggcttcggcctattaamacaataaatcaacaagactctcgccttattacctactaattaggttcgctatgtttaaatattktgarcggttatgcaacgagcaatattcaaaaatgataagtagatcacaaaaaatttaattttctggagtttttttatcatttttatgaatttctcgtagtgctttcgccactatttgaatcgcttctccactactaattccttktgccataagttcttgaatttgctcaactgctttttgttgctgttcgtgtgttaagttaatatcaaacattttcccatccaaattgattcattaattgctgccattgttcatctaaacctgctgtaattgttatttgctctttcgttattggatgaataaaagacaaactatcagaatgtaaaaataatcgagaacaacctaaatgtgacattaatgcacgattttgatgtaagtcaccatattgcgtatcccctmaaattgggtgaaaaacatgtttcatatgscgacgtaaktggtgttttctgccctgtatgagggattaatttaactaaagaataacgcgccgtttgataacgcccagcaggataaggcatttcgactatttttaatccttcataatcagtaatcgcttcttgaggctctttatcttcttgagaaaatttatctgcgattttatccaattgaatttttagtggataatctatccgctcttttccctgtagatacccacgcactacagccaaataagatttctgaacgtacttttgttcaaactgttcacacattaaattcgcaatttcactgctcaatgcaaataacaacacgccagatgtcggtcgatctaaacgatgaataggaaatacgtgctgaccaatctgatctcgtaaagtttgcatcacaaattgagtttcgtgaggatctaaccaactgcgatgaaccagcatacctgcaggcttattcaccgcaacgagaaacccatcttgatataaaatttctagcattcgttattgttcamaagttcttctaaagcaactaaaggagttaatagttgttgtaactcattaaattccttcattgcttcttcaatataaggagaaatagcaattttatttggcaaggctganccactttctaacaatgcctgcatgcgtggaataaatacccactgtagccactcttcggcagacatcgtatcaattgaaaaaggttcttcacttaaaaacgcctctgcagcagggggcatcgtttgccataaattaagctgctgcatggtaatttgaagctgttcaagatgctgtttagtttgattacgcatattttatatcctaattaatgaatgttttttgcaaatacacgcacatttgaaaaaccattttctttcaaatataaggcttgtaatttactcatcacaccacgttcacaatacaacacgtaacttttactttgatcaaggctaccaaattgagaagaaagtttgtagaacggcatttgaatgacgtcatgtgtacctgattcaaatggcttttcatccgtttcttctgggctacgaatatccaaaatcacttcattttcacctaacacagaaattgcctcgacttccacgactgcttttnctgtttcttctgcaatctggcgaatatctaaatattttgcattttgtaccgcactttcaagaatctcaaaattaaaatgcccttcttctttaagaatcttttcacgaaccgctttaatcgtaggattttttgaaatcacgccacaaaattctggcatagattttgcaatatcatcagtgccaatttctttcgccatcgcgataatttgttctttatcatgggtaattaacggacgcaatactaaggcatcagcggcttcatcaatcaagcgtaaattggttaaagtttggctagaaacttgccctaatgcctcccctgtcacaattgcttcaatattgaaacgttgagcgactttacttgcggctcgcaccatcatccgttttaatacaacgcccatttggccgttatcgactttctctaaaatctcaccaacaactccctcaaagtttaatcgcaataaagcgtactttatgtgaagagctatagcgttgccaaatatgataagccatttgtttaacgccaatttcatggactgtgccaccaagattaaagaaacaataatgaactcgggaaccacgacgaatcaacatataactcgatacgcctgaatcaaatccccccgaaattaaagaaagcacatcctcttgagtcccaatcggataaccgccaatcccagcgtgacgtgctttaactaacatcattttgtcatcttcaatatcaatacgaacagttacatctggatttttcaaccgcacttttgcgctttcaatatattgatttaatccaccgccgatataacgttctgcttcaattgaactaaatttatgttttcctttacgttttactcgaacgcaaaaggttttgtcttgaagttgttgtgcgacatcagcaagcgtcaattcaaaaatatgatgtaaatcggtaaatggtttttcttcaacttctaaaaaatgatgaataccaggaatacgttgtaacaaggcgattaattcttcacgattttcttcattttttgaccgcacttcaatgtaatcccagtggcgtacaactgcggtttcttcatcatatttctgtaaaatattgcggatattagaggttaaaatttttgcgaaacgtttacgcacagtttcgctcttaatcatgatttcaggaaaaagtttaacgataaatttcatataaatagcttaggtatttcttggggatttaaagtggcgagtattttacgcaaagatagtgaaaagtccactggtcctagcttgaaataattttttaacaactcaagtaaaatacagtacaatggcaaacaatttttaccgtgaataaaggataattccatggcgcgtaaacccgcatcttcacaagattttgaaacaacgttagtgcagttagaaaatattgttacacatttagaaaatggcgatctaccgttagaagaagcgttaaaagaatttgaacaaggtgtgcaattagctaagttagggcaagaacgtttacaacaagcagaacaacgtattcagatcttattgcaaaaaacagaagacgcgccactgaatgattataaagggaatgattatgaagggaatgcttaatgggtcacttttctgaagaattacaacaggttcaaactcgtatcaatcgctttttagaagctcaatttgaaggcattgaaagtcataatgcgcctttgcttgaggcgatgaaatacgcattattacttggcggtaagcgagttcgccctttcttagtttacgcaacaggtcaaatgcttggcgcagagaaacaaaccttagattacgctgctgctgccattgaagccattcacgcctattccttaattcacgatgatttacctgcaatggatgatgacaatttacgccgtggacatcctacttgtcatatccaatttgatgaagctacagctattcttgcgggcgatgcactgcaaagtttcgcatttgaaatattaaccaaaacaccgaatatttctactgaacaaaaactggctttaattcaaattttagcgcaaggcgctggtgtgcaaggaatgtgtttagggcaaagtttagatcttatttctgagcataaacagattagtttaagtgaattagaattaattcatcgtaacaaaacgggtgcattgctaattgccgcattgaaattaggtttcatttgttctccgcattttaccgacaaaaggttagaacaatccttaacacaatatgcggaagccattggtttagcctttcaagttcaagacgatattttagatattgaaggcgatagtgcagaaattggcaaacaggtgggtgccgatcttgatttagataaaagtacatatccaaaattacttggattaagtggtgcaaaacaaaaagcgcaagatctatatcaaagtgcgttgtctgaattagaaaaaattccttttgatacaaccgttcgtgcattagctgaattcattattaccagaaaaagttaaatacccacaaaagtgcggtcaaaatttatcacgtttttaaaatgactaacaatatgaacaattatcctcttttatctttaattaattctccagaagatttgcgtcttttaaataaagatcagctaccacaactctgtcaagaattacgtgcttatcttttagaatctgttagtcaaactagcggacatttagcgtcaggtttaggcactgtagagctaaccgttgcgctgcattatgtatataagacgccatttgatcagttaatttgggatgtgggacatcaagcttatccacataaaatcctaacgggtcgccgagagcaaatgtccacaattcgccaaaaagacggtattcatccttttccttggcgtgaagaaagtgaatttgatgtattaagtgttggtcactcctctacgtctattagtgcgggattaggcattgccgttgccgcagaacgagaaaatgcaggtagaaaaacagtatgcgtaatcggtgatggcgcaattactgcgggaatggcatttgaggcattaaatcacgcgggggcattgcatacagatatgttagttattttaaatgataacgaaatgtctatttcagaaaacgttggtgcattaaataatcatcttgcgcgtattttctctggctctctttactctacgcttcgtgatggcagtaaaaaaatccttgataaagttcctccaatcaaaaattttatgaaaaaaaccgaagaacatatgaaaggtgtaatgttttcgccagaaagtacattatttgaagaactcggttttaactatattggcccagtggatgggcataacattgatgaattagtggctacgcttacgaatatgcgtaatctgaaaggcccacaatttttgcatataaaaacgaaaaaaggtaaaggatacgcacccgcagaaaaagatccgattggtttccacggtgtacctaaatttgatccaatcagtggcgaattgcccaaaaacaatagtaaaccaacttattcgaaaatttttggcgattggctatgtgaaatggcagaaaaagatgccaaaattataggtatcacacctgcaatgcgtgagggttcaggtatggtagaattttcccaacgcttcccaaaacaatattttgacgtagcgattgcagaacagcacgctgtcacgtttgccacaggacttgcaattggcggatataaacctgtcgtcgcaatttactcgacatttttacaacgtgcttacgatcaattaattcacgatgttgccattcaaaatctccctgtgctatttgcaattgatcgagcagggatagttggtgcagatggggctacacatcaaggtgcattcgatattagctttatgcgttgcattccaaatatgatcattatgacgccgagtgatgaaaatgaatgccgtcaaatgctctatacaggttatcaatgtggaaaacctgcggcagtgcgctaccctcgcggaaatgccgttggtgtaaaacttactcctttagaaatgcttcctattggtaaatcacgtttaattcgaaaaggtcaaaaaattgcgattttaaattttggtactctattaccatccgctttagagttatcagaaaaactcaatgcaacggttgtcgatatgcgttttgtgaaaccgattgatattgaaatgattaatgtgcttgcacaaactcacgattatttggtcacattggaagaaaatgcaattcaaggtggagcgggatctgctgttgcggaagtactaaattcatcaggaaaatcaaccgcacttttacaacttggcttgccagattattttattccacaagcgacacagcaagaagcattggcagatttaggattggatacaaaaggcattgaagnaaaaattctcaactttattgcaaaacaaggtaatttataaaaataaacgcgatgataatttcatcgcgttttttcttaatccacaattcttaaatgggaaactgattttgttttctttttttcttctcgttttttaggcttatctactgcttcataaaaacctgttggttgttcagtatctggctcaatgttaagttcatcataaatttcctcaggttcaaacatcacgccatcgccattctcacgagcatagatcgcaagggctgcgcccattggaatatacagttcacgagagacgcctttaaaacgcgcattaaactggatgaaatcatttgtaagttgtaaattgcccgtagcactggcagacaagtttaatacaatctgtccatcttttacatattcgacaggaacattcacacctaagtaagtcgcatcaacaactaaataaggcgtaaaactattatctactagccaatcataataggcgcgtaataaataagggcgtttaggagaagatttatattccattatttatcatccattaaattttttggtgcagcttcacctacagattgcaaaaaagaatcacgtgtaaacacacgttccatataagctttaatcgctttacttcctgtgcctgtaaattccacacctaaatgttttaatttccataataatggtgcaacatagcaatcaaccaaaccaaattcttcattcataaaataaggcatctgttgaaaaattggtgcaatccctaatagttcttcttttaactgttttaatgctgaagttttttctttttctgtgccattttctgcttttgcaagggttggataccaatcttgttcaatacgtaacattaaaagtcgatctttagcacgagaaacaggatacacttgcattaatggaggatgtggaaaacgttcatcaagatattccattatgatgcgtgaattaaataatacgagatcacgatcaaccaacgtaggcacagtgccgtatggatttaattccattaaatcttctggtagagcttgcaaatcaacttctgcgttttcataaagcacacctttttctgccaaaacaatttttacctgatggcaataaatatcatctttatttgaaaaaagggtcattactgaacgtttacttgatgcgctggacatttattcctccgaagatccaaaaatattctaggtttttaaggggcaacattttaccataaagcattacctatttgccaatataatcttttttattgttttataatcaataagttagagtaactcaaataataaaaaagcagagatttctctctgcttttcttttggaaacgaaaataaaaattaacgttttgagtattgtggacgacgacgtgctttgtgtaaacccacttttttacgttcaacgcgacgtgcgtcacgagtaacgaaaccagctgcacgaagtgctgggcgtaatgtttcatcgtattccattaatgcacgagtgataccgtgacggattgcacccgcttgaccagaaataccaccacctttaactgtgatgtataaatctaacttatcagttaawtcaaccaactctaatggctgacgtactaccatacgtgctgtttcgcgaccaaagtaaacatctaattcacgttggttgatagtgattttaccactgcccggtttgataaatacacgagctgaagagcttttgcggcggcctgtgccgtagttttgattctctgccattttctaaacctcgtgattaaatatctaatacttgtggttgttgtgctgcgtgttggtgttctccacctgcatacacttttaatttacggaacattgcacggcctaatggaccttttggcaacatacctttaaccgcaatttcaatcactgcttcaggacggcgagcgatcatttctttgaaagtcgcttgtttaataccacctacatagccagtgtgccagtagtaaagtttatctgtttctttacgaccagttactgccactttgtctgckttgataacgatgatgtaatcaccagtatctacgtgtggagtgtactcagccttgtgtttaccacgaagacgacgtgctaattcagtcgctaaacgacctaaagttttacctgtcgcatctactacgtaccagtcgcgtttaaccgtttctggttttgctacaaaagttttcattaattaattaccaaaaattagtttgatacccagtgttcttatgaacacaaccattaatcttaatcgccaccccttcgagtgcgatctcgataaaataatgtacgatgggaattcgcacatttacagggtcggcgtattatactcgttttttcataaaatgctaattttttgcgctaaaaaacaaatctattgtatttatttaacacgcatttatctttctataaaaatacacaaaaaattaccgcactttctttttcgttgtaaaatggggtaaatcattgctaacaaaagtgcggtagttttgagtatgtgttgatctaaaaattagttattattgaacaataattatccatttattgaattattaataataatcatacttttaatgaataaattgaaattgactcatattaaaacctattttattgtacaaatactattttagaatcctaaaggaagccttatgagctacgcgaaagaaattgatacattaaatcaacatattgcagattttaataaaaaaattaatgtctcctttgaattttttccacctaaaaacgaaaaaatggaaacccttctatgggattcaattcatcgtttaaaagtattaaagcctaaatttgtgtcagtcacttacggtgcaaattcgggagaacgtgaccgcactcacggcattgtgaaagccattaaacaagaaactggcttagaagccgcaccacatttaactggaattgatgccacacctgaagaattaaaacaaattgcgagagattattgggatagtggtattcgccgtattgttgcgttacgcggtgacgaacctaaaggttacgcgaaaaaaccattttatgcgtcagatcttgtggaattactccgttctgtcgctgattttgatatttctgtagccgcttatcccgaagttcatccagaagcaaaatccgcacaagcagacttaattaatttaaaacgtaaaattgatgcaggtgcaaaccacgtcattacacaattttnctttgatattgaaaactacctacgttttcgtgatcgttgtgcatcaattggtattgatactgaaatcgtacccggtattttacctgtnactaattttaaacaactccaaaaaatggcatcattcactaatgtgaaaattccagcgtggttagttaaagcctatgatggtttggataatgatccaactacacgtaatcttgtggcagcaagtgttgcaatggatatggtaaaaattttatctcgcgaaggcgtgaatgacttccacttttatacattaaatcgtagtgaattaacttatgctatctgtcatatgttaggtgtaagaccttaattatcacaataatatattncttttcaaacacaaaataagggcgatatttcgcccttatacaaaactaaaaaaattcaaccgcactttattattttatgaactctgtttgcatatacattaatcgatctatattcgttaaataatgccctaattcttgttcttcgggtttatgtaaataaggaattttacctaaaagcggcgcatcaatatgttcaacaagtaaatcaacaatttctgcataatggcttaataatggattaattcgatttgctatccaacctaataacggcacacctaactgttggataacctttaccgtcaataaagcgtgatttacgcaaccatctttaattccaactacaagtactactggcattttttgttgagcaatccaatcagcaaaactttttccttctgccattggtgtcattaaaccaaaagatccttccaccacaacagattgataagtttgattcaaacgcgttaaatcacaattaattttatctaatttaatccgcattttatcttgtgtgagcatgggtgcacagtggctaaaagtataactattaatatcctgataagacacattttcttttgttgaatgcatcagcgttaatacatcagcatttacgaaatgatcataatcagatgtattttctgattgcgcgacaggataaatactctcttctccacaacaagcaataggtttatagccgacaacttgcactccctgcccttgcaaggcttgaatcattgcgcgcgctgctgttgttttccctacattcgtatctgtccctgcgacaaaaaagctactcatttttttctcctttaaaaagtgcggtggattttaaaggaattttttatttaataatttgagataacgcaaattttcactttttttatcttataaatagacaaattatttgatctcactcaagctattaaataaaccatcatcttgttttgctatttgtaagtaaaatccttggcgtttaattgtttccaatacttcattacaatctacattgtgtagtgctttacgcccaagcagattaaacatcatcactaattctggtttaccaaaatgttcgagtaaaacgctgggcactgaagaaaaatcctctctattggcaacataaaggtaacttcctaacttctttttacttttataaatggcacatagcatatttaatttcccgaaataaaaatccgcacattttacgtgcggattacaatttatcatttcctatttttgaactgtagctaaaaattctttacgagtatctctatcttctaagaatacgccaccataagcagatgtgacagtataactattcgtatctctaataccacgcgctttcacacagaaatgggtcgctttcacatataccgccacatcatcggtctcaagaatggtttgaaatgctgtcaaaagttgctcagttaagcgttcttgaacctgtggacgttgcgcaaaaaacgagacaattcgattaattttagaaagaccaatcacccaatcttttggatagtatgccacacaaactttaccatcaatcgtcacaaaatgatgttcacaagtgcttgttagcgtaatgtcattcacttgtaccatttcgctgactttcatttgatttttgatttttgtcatctttggaaaattcgcataatccattccactaaaaatctcatcaataaacattttagctaaacgatttggcgtttcttctaaactatcatctcgcaaatctaatcctatcagcttcattacttcatgcatgtgttttgcaatgctttctcgacgttcatttttagcctgtgttggatcaatcatgggtgtctcaatacctttttcaatcaaggcatttcttacattcagtgcatccagtgaaattttgctcataatagtctttcctaaaaaaataatcggctattctagcaaaggataataggatggtaaaatgagaaaaattgcaaatttgaatgaattaggctttagatatagaatagctgacaaattttatcaaataaggattttctatgcttacattggatcaagctcgctcgaaaatgcttgaacagcttcccttcccgactcaaactgaatacctaaatttacaagaagccgccaatcgaatttgtgcagaagatattatttcgcctatcaatgttccctctttcgataactcagcaatggatggttatgctgtacgtttatcggatttacaacaatctttaaccctttcagtggcagggaaatcttttgcaggtaatccattccaagaggaatggccatcaaaaagtgcggtcagaattatgactggtgcgatgattcctgaaggcacagatgcagtgataatgcaagagcaagtaacactcaatgaagacggcaccatcacttttagtgaattacctaagccgaatcaaaacatccgtcgtattggtgaagatgtaaaaaaaggggatgtcgtattagaacaaggcgcacagctcaccccagtttccttgccattattggcctctctaggcattgcagaagtaaaatgctatcgtcaattaaaagtcggtgtactctcaactggcgatgaacttgtggaagtgggcaaaccattacaaagcggacaaatctatgacactaaccgtttcaccgtaaaattactgctagaaaaactacactgtgaagtcattgatttaggactattacctgataacgaagctgaatttgaaaaagcatttattgccgcacaaagccaagccgatttagtgattactagtggcggtgtttccgttggtgaagcggatttcactaaagcggtattggaaaaagtaggtcaagtaaatttctggaaaattgcaatcaaaccgggcaaaccattcgcttttggtaaattagaaaatgcttggttctgtggtttacccggcaatcctgtttctgcattagtaacattttatcaacttgttcagccattaatcgctaaacttcaaggccaaaaacaatggaaaaaaccaccgcacttttcagccattgctacaatgaatttgaaaaaagcagtgggacgtttagacttccaacggggtttttattacatcaatgaacaaggccaaattgaagtgcaatcagtaggtttccaaggttctcatctctttagtgcttttgtaaaaagcaattgttttatcgttttagaacaagaacgtggcaatgtctctgcgggcgaaacagtgacaattgagcctttcaatcatttattaggataaaaaatgatcgaacttagtcacgaagaagaattgcgttataaccgtcaaattattcttaagagcgtagattttgacgggcaagaaaaacttaaagcaagcaaaatgctgatcgttgggcttggtggcttaggctgtgcagccagccaatatctcgcagcagcaggtgttggaaatttaacgctgttggatttcgatacagtttctctttcgaatcttcaacgccaagtcttgcactgcgatgctcgcttgaatatgccaaaagtggaatccgctaaaattgcactggaacaaatcaatccacatataaacatagagacgattaatgcgaagttagacgaagaaaaactcgcagaaatcattccgcactttgatattgttttagattgtacagacaatgtggaaatccgtaatcaattggatcgccaatgtaatcatatgaaagtccctcttatttctggcgcagcgattcggatggaaggtcaggtttccgttttcacttatgaaccaaatacgcctacttatcgtgatctcagcaaattatttagacaaaatgtattaagctgtgtggaagctggcgtgcttgcaccaatcgtcggtattgtgggctgcattcaagccttagaagcaattaaagtgcggttaaaaatcggtaagaatttgtgtggccgcctattgatgattgacggtttttcgatgaatatccgagaaattaaacttccaaccaatatggaataaaacgcttcaaaagagaaaaaaatttaaccgcacttttatgaaccataacctttacgacaaaacactatgacaacagaaattaaaaaacttgatcccgatacagccattgatattgcttacgatattttcttagaaatggctggagaaaatttagatcctgctgatattcttttattcaacctacaatttgaagaacgcggcggcgtggaatttgttgaaaccgccgatgattgggaagaagaaattggtgtactaattgatccagaagaatacgctgaagtatgggtgggcttagtcaatgagcaagatgaaatggatgatgtctttgctaaattcttaatttctcaccgagaagaagatcgcgaatttcacgttatttggaaaaagtaacgataacgtaaaaataagggaaatcatctgatttccctttttcttttcgcttaaaattaacaagccatcaaattggaaaacttgagaaaaaaactaacaacaacggcggtaataaatttgtcaccataccaaaagaaatggcgataggcgtcacttcaattccacctgatttttgaataatcggcaatgtacaatctaatgccgttgcgcctgtaatctcaatagctgtagagcgataatgttgcataaacaatggaattaaaaataaactcaaaatttcacgcgataaatcattgaaaaaggcaatactgccctgcatcggcccccaagcatttgtcagcacaacacttgataaagaataccaaccaaatcccgatgaaaaggctaaaccttgagtaatcggcatacttagaaaaaatgctgaaataacgcccccaattaaagaacttagggtaaaaattgcccccatcattaaaccctgcttatttagcaagacttctttcaaggaaatgccattgttacgaagctgaatcccaacaaaaaagatcaacgtaataagcacgtaaagattggaaccatttggaaaatgcaaccaatctttgcacagccaacctaaaacgatgccaataattaccgcacttaataattcttccattgttgtccttttttgtagatcactgcactttatttaattttcaaaggtaatttgaataaatattacagtaaaaataaaaaactattatacaagcaataaaatcataccgcttataatatagttttttatcaatctaccaaatgctcaatgttcaaatgccaatcttagatactttgtctctttactctgtaaaaatggaatataaaaagcggcttaaaaataagccgcttgtcatcgttatttttcagcaaacactcgaatttgctctgcacctaaatgtcctggtacggtttttttcaggtttaaatcactatctaaaaagagattaaacggatagccacgcactcttgctttatcaatgatttcgcctttttcatctaaaagcaccgtgatatttttatattctaatcccttgtaccactcaataaaatcagcggtgtctttttcgcctttgtgatcgggcgaaacaatggtaatcacttcaaaattgcgatctttttccgcacttaaatcatcaatttcagctaatcctgccaaacaaattggacaccaagatgcccacatttttacatacacgggtttgcctttatattggcttaaagtaactggctgattgtttaaatctttgagttgcacatccgccaaattagtttgtgcaaaagcgtttaggctgaatgccattagaaatattgatagtagttttttcattgctttttccttttataaatttcttttgttgaggttatgttttacgaaaaattattcgtaatcaataaaatacccatcacgataattaaaattccgccaccaattttaaatttgtctaagtgtttatttaaccctttggcacgttttagcaagctgtctgagaagaatgaaaataatacaaacggcgttgccaagcctaaaacataaacgaacatcattgatgcaccgtaaagtgcagatccttcatcgcctgataaagctaacacggaagccaaaatcgggccaatacaaggtgtccaaccaagactaaaggttaaaccaaggacaaatgcctcaagtgcggttgattttcctgatgtttttatttccaccaattttgtgcgttccaacaaaccaattttgaaaatgccaagttgatgaatacccaaaataatcacaataacgccagcgataatgcgggtggtgttactaaataaaatattccctaaaaaaccaaaactaaagcctaaactgacaaatgtaagggaaagccctaaaataaataaaaaagtatttaggacttttttaccgcctttactcaaaataccaaaataaattggaataatcgggaaaatacaaggcgaaagaaaagaagcaagccccgctaaaaatacagttccaataaggagttgttgatctaacatcctacatctccttattttttaatggattgaatcaaatatccatatcctgccttttccatttctgctaacggaataaatttaattgatgcactgttaatgcaataacgcaaaccacctttatctttcggaccgtcatcaaaaacgtgacccaaatgggcattgcccgcacgacttaacacttcggtacgttgcatattgaagctgttatcggtttcataatgcactacatctttaatgatcggtttcgtaaaacttggccagccacaacctgattcaaatttatcatttgaagagaaaacaggctcgcctgtagtgatatcaacataaataccaggttggaagttatcccaatattcgttactgaaagagcgttcagtatgtttattttgagtaacggaatattgcaacggtgtcaatttcgctttgagttctgcatcactcggtttcggataatctttctcgtcaatcacaggttcatcagctttggtaatatcaatatggcagtagccatttggatttttcttcaaataatcctgatgatattcttctgctacgatgtaatttttaagtggttgcacctcaatttgtactggttttttatatttggtttgaagctgggcgagtgcttgtccgatcaccgctttatctgctccatcttgataataaatccctgtgcgatattgtctgccacggtcgttaccttgtttatttacgctggttggatcaatcactttaaaataatatttaagcaatttatctaacgaaatttggtttgcatcgtaagtaacttttaccgtttctgcgtgatcggttagcccaatcatctgataactggttttctccgtattaccatttgcatagccagaaatcgcatctttcacgccgtgaatacgctccatatatgcttccataccccaaaaacagccgccagcaagataaatttctcgaatgttttgtgtattttccattgccattttttgttctccagatgatgatgttgaattttgtattgctaaagttggtgtagcacagcaaagtgcggtaataaatagaaatgtttttgatagtttcattgtttttccttatgatgtgaaaattaacgttacataaggttagacggcggataatccgatttcttacagatttttttacttaagtttgaaatgtggtagaaaataagaggggaattttaaataaaaaagactaagtctaaattaaatatagacttagtcttgtttaaataaaatgatgttgttagagcagaattttaatgacttactgccatatttagtttagaaatagccttcttaccttcttcttcagaaacttgttctaaatttgcaccgcctacaaatacaccaaatttagtatattgacgaataaaatagtttttaccactttcagttttaatgtttaaatcactattgctgaattcggattcagttgaaattttatgctctcccgctttaatggttttataaaaaaatacatcaggagcagactcacctataaatttatcgtcaatatagagatctttctttaaagcttttcctataaaagaatcacggtagatatataatcctgaatttcctttttcgggagatctgaattgtttggcggtattactttcttcaacagaagccataggaacggttgcacaagctgaaagtaataacgctacccctataattgatgctcttgcaaataactgtttcacaaaatatccattagaaactaaaacgtaaaccagccttaacgcccacatcagaaacatttgaggctaaacggttatattcaatattagtattaagtgccacgttatcagttaatttatattgaacaccagctaatgcaccaatgcctattctcgtttcggttgcaaaagcttctatgcgataatatcttgcatttgcagttacatctgctccattggtagatacacggacaccaacataaggtttgaaatcggctaagtcaaaatcataaaaaccagtgaggcctaatgatttacctttaagagatacatctacaacatcagcataatttgcagttacttttccgtagtttgtataatctacggctaaacgaaagttcttatcaaaagcatagccaacactaattcgttgggtaaaagatggactgtttgaactatttacatgagtaatatcaatttttgaagcacctaaatcgccttgaacataccattgagcttgagctgatagtgctaaagtaaataacatagttacaataagtaattttttcatagattaagacctctaaatgtgtgaaaatacatcagttgcataagtaaatgcgggtaaattttatggaagtttaaccattaaaaacaacaacaaaaaggacaaaatagcacctaatttcggcaaaaattgctcaatttcgaaaggattaaatttagatgggaatgcacgataaaattcgtatgatgagagagcttcgtcaattatcgcaagaagatatggctgagaaaatgaatatgtcgccaagtggttatgccaagattgaacgaggtgaactcgcctacaatacgataaattagtgcaaattgctcagatatttaatatgaatttgtctgaactagtggatgagaatagaggaattatatttttattaaatgaaaatggaaataatacatcaactaactattatggaaataacgactctttaataattgaaattgaaaaattaaaattaacactttttcataaaaatgaattattagagcagaaagaaaaagaattagaaacgcttagaaaaatgatttcattattagaaaagtgaaataaagtatttttaacaataaacggttgaagttgtaaaatattttgcaaattcaaccgcttattttttgctacctatcagttaattctatagatggttcggcatccctaaattgcttcatcatctcgcttaaggttttgcaatttctttgaaaacgacgacaatgtgggcaggtaactaaatgaactcttaacccaactttttcttgtatatctaatgaacgttcgtgcgattcggaaatcattcgagtggcttggtgacaacgcataattttctcctaaagtttttttgaaagacagttttgcaactgtaaacgagcccgataaagggtggtatgtaaattagacgaagttaaatgtgtttcttgacaaatttcttcagatgaaagctctaaaaactctcgcatcataaaaatttttgcctgtttagcaggtaaacaattcaaacaagtttcaaaaatcagccaaaattcatcggaataaaccgtttcttcttcgccttgtaattcactcgggtgatattctggtttccaatgccccttttcatcaaaaaatgaattattagtattttcatcttcaagttcactttctaaaacaaaccgccctttctgacgtaaataatcaataatcttatttttaagaatcgcaaaaatccaagtcttaaatgcagattgacgcttaaaattagcgagatttttgaatgcacttaaaaaagcttcttgtactaaatcttcagcaagatcggcttgatttacttgcaattgtgcaaatgtcagcatttgagtgcgaatttgctgaagctcaagatcagaaataacattcattttaattcctttaaaacttatgtaagaaatgaaactcacttcttttaacaaactaaggtagctatttttacactcaaaaaaggaaatttaaaatgaaaaattttatattgaatctattttgcgaagttaggaaaaaatcaggtgtttaagaaaagaataattgataccgctttttaacgtgatatttgcttggtgtgtagccgacaccaattgccatcgcattacaaaccgcccaccgcagcagaaaaactcgcttttccaacgacttgaggtaacactaaaccagaaagggcgttagccgccactaaaccacgttctaatttgctgtccaatttccctaatttgccatttaactcgttaaagcctgattggaaattattcatttgagtttgtaacgtgcctaatttgagatcggtatattgatttgcagtttgtaaagtttgtgtatcgccatcttccatttgttttttatttactgcatcagtgtctttttcggctgtttttacattagcaacatatctttctttaccttctctaccaaaagaaacttcattttctcttgtagtttctgaactatatcctacagcaatagagttgttatatttagcttttgctttgttacctagagcaatagcattttctacttcattagtaccagtttcatttttagcttcactttcataacctatagcaatgttatatgaaccttcaaccttatttgcccccccaatactgtattatatataccatctttgtaagtcctaaagtcttcggcttttttactattaattgtattattctttaaattaccaatgatcaggctatacgccccaaactctttaatgccgtaattcgtactaattgaattttcactcgccgcaaaggcttgagaagagatcagcaaactgctgataagttaagctgtcgtggttagcttgacagatgaaaagaaaagattagcattgcttgcttgcttgcttgcttgcttgcttgcttgcttgcttgcttgcttgcttgcttgcttgcttgcttgcttgcttgcttgcttgcttgcttgcttgcagaattgtaataaaacatattatatcctcctaggataaaacaaaaaagaagcgtgactttacgttaaataaattgatgtaaaggaaatacaaattttttcgtgcaaattccaatatttaactttaaaatacttgcctctgaacaaacattcattataaataaaagtcacaatatttattttataaataaaaaagtgcggttaaaatcatccgcactttttagttcgtagaaaggaaaattcaatgtttaaaatgaaaaatatcacgcttgctttgttgatgtctggtgcattggtgggatgtgccaatattggcgattcttatcaagcaagccttgaagattacaagcaatatgaagaaattaccaagcaatataatgtaaaagaaaattggtggtcgttatatgatgatgcgcaattaaatcgcgtagtaggacaagcattaataaacaacaaagatttagctaaagctgctgtagcggtaaaccgtgcactttatagtgcaaatttagtgggtgcaaatttagtgcctgcatttaatggttcaacttcatcagcagcacaacgccgagttgatatcagtacaaactctgccatttcacacaaaggttctttaaatgtgagctatacattagatctgtggcaacgtttggccaataccgttgatgcggcggaatggtcgcacaaagcaactgcagaagatatggaatcggctcgtttatcattaatcaattctgtagtaacaacttattatcaaattgcttatttaaatgatgcaattagcacaaccaacgaaacgatcaaatattacacggatattggcaatattatgcaaacgcgtttagtgcaaggcgtggctgatgcagccagcgttgatcaagcacaacaagccatattaacggcacgtaataacaaattaaattttgaaacccaacgcaaaacagcagaacaaacactgcgtaatcttctcaacctaaaaccaaatgaagcattaaatatcacgttcccacatattatgaatgtgaaaacagcaggcgtaaacttaaacgtgcctgtgtctgtaattgcaaatcgtcctgatgtaaaagcagcacaattccgtttaagcagtgcattcaaaaatgccaaagcaactcaaaaaagttggttcccagaggttaatttaggtgcaagcctttcttcaacagcaagcacggttggtacggcgttacataaccctgtggctgctggcacagtaggaattagcctaccgttcttaaattggaacaccgtaaaatggaacgttaaaatttctgaagctgactatgaaacagctcgtttaaattacgaacaacgtattaccaccgctctcaataatgtggataccaactatttcgcatttacccaagcgcaaagtacattaagtaatttacagcaaacccatagttacaatcagcgtatcacacaatattatcgaaaccgctataatgcgggcgtatccgaattgcgcgaatggttagttgcagccaatacggaaaaatcatcacaacttgcgattttgaatgcaaaatatcaagtgctgcaaagtgaaaatgcggtatatagctcaatggcgggatattatttgtaaaaatcaaattggattaatctatgaaaaatccctgttaaatttctttaacagggattttgttatttaaattaaacctattattttgtcgcttctttcactgcatctactgcttgagttgctttttctgaaaccgcctctttcatttcacttgctttttctgatgctgcttctttcatttcgcctactttttctgacgctgcttctgttgctgatttaattacttctttcgcatcttccactttctctgctactttatttttcacgtctgtagaaagctgctgtgctttttcctttacttcagtcattgtattagctgcagcatcttttgtttctgatgcgactgatgctacagtttgcttcgtatcctcaactttttgttttgcttcttgcttatcaaaacaacctgtcacgactaaagctgaacctaaaaccaatgctaatgttaattttttcattattttctccatagaataatttgattgtnacaaagccctattactttgatgcagtttagtttacgggaattttcataaaaagaaaaacagtaatagtaaaactttacctttctttaaaaagattactttataaaaaaacatctaagatattgatttttaatagattataaaaaaccaataaaaattttattttttgtaaaaaaaaagaatagtttattttaaataaattacaggagatgcttgatgcatcaatatttctgatttattaccatcccataataattgagcaatagttgcaggataaaatgatattggatttcgttttccatacagttcagcaacaatttctcccactaagggcaaatgggaaacaattaatacagatttaacgccctcgtcttttagcacttctaaataatcaatgactgaatgcgcatggccataaggcgtaatcccctcccaaatttcaaatttattttctaactccaaatcaaacgcttgattaacttgatgaaaggtttcttgagctctgacataagggctcactaaaatacggtctagtgaattaattactagcgtgcttaaatgctgttttaaccactgcccttgtaaaaaagcctgtttagaaccataaacagttaaatggcgagctttatcactattagccattacttccgcttcgccgtgacgcataataaaaatgttcattttgctttcctaaaaactttataaaaataaaccgcactttactaagtgcggtcaaaaattaattaatttttttcacggcttctgcaatttcttctgcacattgttgtgcaagttcagcatcttggcattccaccataacgcgaataagtggttccgtacccgatttacgcaataaaatacgacctttaccttctaaacgtttttcaacctctgcggcaacagattttacagcatcactttcaagtggattttccccacccgcaaaacgtacattgattaacacttgagggaataatttaaccgcacttgctaattcatttaatgataatttatgctgtgccatcgccgccaatacagccaatgacgcaacaatgccatcacccgttgtattcttatccgcaatgataatatgtccagaattctcccccccaagcgtccaatcattttcaaccattttttccaatacataacggtctcccacgtttgcacgtaagaagggaacaccaagcattttcaacgcaatctctaagctcatattactcattaaggtgccaacgacaccgccttttaattgacctgagcgcaatgcttcacgcgcaataataaagagaatttggtcgccatcgactttatttcctaaatgatccaccatcataatgcggtcaccatcgccatcataagccaaaccaacatcagctttcgtttcaacaactttagcttgcaatgcagtcacatcagttgcgccacatttttcattaatgtttaaaccatttggatccgtaccaatttcaataacttccgcaccaagttctcttagtacattaggggcaatatggtaagttgcaccatttgcacaatctaccacgatcttataaccttccaagcctaaatgagcggggaatgtacctttacaaaactcaatgtagcgtcctgctgcatcattaatacggctggctttacctaattcagcagattccacacaatccatcggttgctctaacattgcttcaatagcttcttcaatttcatcaggtaatttagtgccttttgctgaaaagaatttaatcccattatcataataaggattatgagaggctgagatcacgatacctgcttcagctcggaaagttctggttaaataagcaattgcaggtgtcggcatagggccggtaaatgcagcagataaccccgcagcagccaaacctgcttcaagggctgattccaacatgtatccagaaattcgggtgtctttaccaattaaaaccattttcgaaccttgagaagccaacacttttcccgcagcccaacctaattttaatgcgaaatctggtgtaattgggtaagcacctacttttccacgtacaccatctgttccaaaatatttacgatttgccataataaaattcctttaattttttatcgttataaaaccatcaggcatttgctgttgcctgccaaactttgagcatatctgatgttgcagcaacatcatgtacgcgtaaaatttttgcacctttttgcactgcaataagcgcacctgccgcactgccaattattctttgatcaacaggtttatcaagcactgcgccaatcattgatttgcgagataaccctgctaatacgggataacctatctgacaaaattcattcagattttgtaataattgataattatgctgtacagatttgccaaagccaaagcccatatcccaaattaaattttcttttttaatgccagcagaaaggcattcattagtacgtttttgtaaaaaagccaatacatcttgcacgacattttcataataaggatttgcttgcatcgtgcgaggttgcccttgcatatgcataatacaaacaggtaaagccagttttaccgccgtttctaacgcattcggctcttgcaaagcacgaatatcattaatcaaatccattccaacatttgccgcttcacgcatcacaacagcttttgaggaatcaacagaaatccagcaatcaaaacggtttcgcaccgcctccactactggcacaacacgatgcaattcctcttgttcagaaacttcatccgcattcggacgagtggattctccaccaatatcaataattgtcgccccctcttctagcattttttcaacttgaaaaagtgctttatctagactaaaaaactgtccgctatcagaaaaagaatcaggcgtaaaattaagaatccccataatttgaggcacgcttaaatcaagacatttattatttgcgtaaagtttcataaaatgcggttaatttttagagtgattttggtgggcgattatagcgaaatacatccaagaacaaaatcattaggaaaaaataaagcctttccgaagaaaggctttgatgagttaaacattaaaatcatcggtattttctaccgcactttcgggctttgtatcattcgttgttgaatttgcataagcagcctgctgagttttcggctctccccaacctgatggcggtgtgacaggttcgcgattcatcaattgtttaatttgttcttcttcaatagtttcatatttgactaatgcatctttcatcgcatgaagaatatccatattgtcgatcaaaatctctcttgctctcgcatagttacgatttacaattgcacgcacttcttcatcaatcgaatgcgcagtttcatctgacatatgtttcgctttcgccattgaacgacctaagaaaacctcgccctcatcttccgtataaagaatcggacctaacttttcagagaatccccattgcgttaccatattacgcgcaatattagttgcgactttaatatcatttgatgcacctgttgagatattttcttcgccgtaaatcaaatcttccgctaaacgacccgcatacaaggtagaaagcttactttctaattgtttttggctaatactaatttgatcgccctcaggtaagaagaatgtcacacccaaggcacgtcctcgaggaataatggtcactttgtgaacaggatcgtgttcaggcactaaataccccacaatcgcatgaccagcttcatgataagcagtggattctttttgcttatccgtcataatcatagtgcgacgctctggccccatattgattttatctttcgctttttcaaactcaagcatggttaccgtacgtttattcactcgagcagcaaacaaagccgcctcattgactaaatttgctaaatctgcaccagaatagcccggcgtaccacgcgctaacgtcattgcatcaacatcttgcgcaacagacactttacgcatatgcacttttaagatttgctcacgacctttcacatcaggtaagccaacaactacttgccggtcaaaacggcctggacgggttaaagctggatcaagcacatctggacggttagttgctgcaataacaattacaccgtcattaccgctaaagccatccatttcaactagcatttggtttaaggtttgttcacgctcatcgtgtccgccacctaagcccgcaccacgttggcgacccactgcatcgatttcatcataataccattgattaatgtaatagacattaaatgataatgattttcatttcttaatttgttgtattttttttatacttgtaacctttttttaacctagatttaacttttgggaagcaatttatgaattttaaattaagcttagtttacaccgcactttttgctgggatttctgtttctgcgttagcagaaacgcgacataaagctaatactgaaacgattgaacaaattaatgttcaagatacaggtattaaacaaaatggttatcaaacaacagggacatctgtcgtatcaaaagctgaagtgccagtattcgacacgccaaacacagtaaatattctttcaactaaactactagaagatcgcaaacctgaatcactcattgatgcgctttataacgtcagtggtgtgagtcaagcgaatacgttaggtggtatgtttgatgctatccaaaaacgtggttttggtagaaaccgtgacaactcaattatgcgtaacggtttacaagctggcccagctaaaaactttagcgcgacaactgaaaccgttgaagttttaaaaggacctgcatctgtactttatggtattcaagatccaggtggtgtagagttaatatcattactaaaaaaccacaacaaacgccacgttatgtcgttggtggaaccttaggtaatcatagcctgtggggaacgcaattagattttactgatggtttaggaaatggttttgcttaccgctttatctatgataaacaagaaaaagattactggcgtaattttggaaaaatcaaaagtacaacttatgcaccatctctttcttgggaaaatgataaaactaaagtagctctttcttatgaacacaaagatattcttgagccatttgatcgtggtacaaatcttttaacggcaactaatgcattacctaatattcctgtttctcgtcgtttagatgaaccaaataacgaaacaactgcaaaaacagataatattgattttaaagttgagcacaaattaagtgactgttggaaattaaattttggctatagctacgcacgttataaacatttctataatcaagcccgaattaaagatattaatgtatcaaacattaatcaaccaaaaaaaccaataaaacacttggattaactgctcgtagcgcaactcgagatattgagcaacaaactggagagcaacgtatccatagtgtttctttaaacacagtcggggaatttgctattggagatattgcgaatcgctttgttgtgggcacagatcttatgagaaataaaatggatttaggaccaatttataatactagagacataaatgatggtaaggttattaatattgacaacccaaattataccaatccagtggcaataaagnaaaatgaaaataacaatgcctaccaatttaatcacttaaaaactttaggtctttatattcaaaataccacttattttacagataactttattataacgggaggacttcgttatgaatattttgatcaagttgttggtcgatcaacattaaagaatattagaagtggatatctggctcaaaaagacgggaaacttctctatcagttaggtagtgtttataaatttactccaaatattgcaacattttttaaccatgcagaatcattccgtccacaaaataatagaacgcttattattaatggcgaacttcctgctgaacagggtaaatcttttgaaacaggtctaaaatatgagaatgcatatttaaatgcaactgtagctttatttaatataaacaaacgtaatgttgcagaaacagttaatgttaatggcacaaatgaactacaaattgttggaaaacagcgttctcgtggcattgagtttgatctaaatggacaacttactgataatttaagtattgcagcaaactatacttacacaaaagtaaaaaacctagaaaatcacaacaataaattagctgttggtaaacaactttctggcgtaccaaaacatcaagcatcattattcttagcctataatatcggcgaatttgattttggtaatattcgtgtcggtggaggtgcgcgttatttaggttcttggtatgcctataataatacttatacaaaagcgtataaacttccacaggctattgtttatgatacatttattgcctatgacacaaaaatttcagggaaaaaagtatcctttcagttaaatggtaaaaacttatctaataaagtttactccccatcaacttcagggaatgcaagcagaacgcttattcctgttgcgttaggttatgctcgtgaagttatattaaacactaaaattgaattttaattagtcattaaaacctagggcaaactggcttcgctctttttctatttatggaaaactaatgaactggcaaaccgaacttaataatagtttaaactggattttaaccgcacttttttgggtggtattgtgctttagcgtaacaatgttagccttaaaacaaactactttcggcaaaaaattctggtgtattgtctctccatcaatggataaaaaaacaagcattaaactaattttaatgttgttagtactatttataatgatattgttggaagtacgatttagtgtacttaattcatttttttacaatggattgtatagctcaatgcaagaattaaatattgagaaattttggttctttgcaaaactaaatgctctccttgtggtagcacaagttatacatgccattgctgattacttctttcaacaagtatttgaaattcgttggttggaaagctttaatgcaacacttgttaaacgctggctaaataagaaaaaatactatcgcctaaaatatgaacgagatttaccggataatatcgatcaacgtatcgaacaagatgcgagagaatttattaccagtacagtacaaattgtgcgaggcgtgattaactcggtgctcacgaccattgaatttacgattattttatggtcactttccggcgtattaactttattcggatttaatatcgaaaaaggcgttgttttcttcatttatgcctttattatttttgcaacactcatgtctgtttggattggtcgccctctaattaagctaaattttacaaaagagaaactcaatggcgattatcgttattccttaatccgtgtacgagacaatgcagaaagcattgctttttataatggcgagccaaaagaacaaactttcttacaacatcaattccgtcaaattattcataaccgttggtccattgtattaaaaatgttgggcttaaatagtttcaactctggagtaactcgcgtggccaaattattgcctttaatgttacaagcaccacgttttttttctggtcagataaaactaggagatatgcatcaaacagtccaagcatttaaccgattaatgaccgcactttcattcttccgcttgttctatgagcaattcacactctatcaagctcggttaaatcgtctttatggttttataacaaaaatggatgaattagataaacaaaacgttcatcatccttttcattgctctcatcgtgtcgccttaaaaaatttcggtattaaagatgaacaaggtcatgtactactcaataatttaaatattaatttagaaaatggagatgccctattgattcaaggtgcatctggaacaggaaaaacatcgctactaaaagcaattgcaggaatctatccttttgaaaccataggtattgcagagcatccatgcatgggaagtttattcctgccacaacgaccttatatgccgcagggtactttacgagaagcaatttgttatccaaatatcaatccaagtcacgcagaattggaacaaaccatgaaggattgtgcgctaggaaaatatatacacgcacttaatgtaaaaaatgactggcaagcgattttatcgcccggtgaacttcaaagagtggcgtttattcgtattttactcacaaaaccagatgtcgtatttctcgatgaaacgacttcagcattggatgaaacaaccgagaatttactctaccaaacaattaaagagcgtttgcccgaaatgatcattctcagcgtaggtcatcgtagcacattacagcaatttcataacaaacaactaaaattagatgtatgtttattatgtgaaaattagaaaatagcaagttaatatatcagccaaatattttatttattttgatgctagtctgaagagcgcctataaaattaaaataaaactataaaaaaagcctcgatattcgagggcttgattttttactatcgtaataaaaattagcgacgtaaacctaaacgagcgatagtgctttggtataaagcaagatcagtacgttttaagtagtctaaaagtttacgacgacgagaaaccatacgtaataaaccacgacgaccatggtggtcttttttgtgctctgcgaagtgagtttgtaagtggttgatttgtgcagttaataatgcgatttgaacttcagaagaaccagtatctttcgcatcacgaccaaattcagcaacgattgctgcttttttttcagtacttagagacattttttactcctaaaaaagagcgatcaaatagcaattcaaaaatggatttatgacggaagtgttctaaatttaacgtagttaatgctaattgattaaaggctatcgttaatttttgataaatttttttagaatcagctaattgaagcacatttccaggatttgcactaataaaaatatcacctctattcccttgctcaatttgttgacgcaagattccggctggaccacaaaatgctttaatctctatatgatgaatttgtcgaaaaatatcagataattcttgcagagcataacaaaaactacctgcgctaaaaacagtaattgattccacaagttttccttactttaataacgttttatacaagggaacaaaatgcgtaaaaaaagattctttatattgagcttgttgttcaaacatcggtaaatgaaaaagtgcggtcaaattttctgaggttaaaatattccttgtttcgccaaatttaaaattttgtttatttaacaataaagttttattggctatcgctacaacttgattaggttgatgtgttgtgaatacgacagtcatgttctgtgattgtgccaaatcgataagtaaagacagtacaatatcttgatttgcaagatctaatgctgaagttggctcatccaacagtatcaatttgcattctgaagcaatggctctcgcaattaaaattagttgtcgctgcccgcccgaaagcgaagtaaattcgcgctttgccaaatgggtcaagttcaaataatccagtgcctgcatggcgacttgataatcatgcgatttcggtttggcaaaagtattaatatgggttgagcgccccatcaacacgatatccaatacggaataagcaaaaggcgaagaaaagaattgcggcacaaaaccgatagattgatacacctcaatcttgccctgaatcgggcgatgaatgccaagcaacaaatccaacaaggtacttttcccgcaaccgttttgccctaaaaccgccagaatatctcctttattcaaatcaaaattcagttgctgaaacaggaagttttccgcttggtaataaaaacctagattttccacggagagcgctttattcattcatgcctccgcgttttagtttatataccaatacaccaaacaacggtgcaccaataagtgcggtcaaaatactgattggaatttcggcatcggatagggaacgcgcaacattgtccacaagcaacatataagtcgccccaacaagcatggtgcaaggcaataaactttgatgattggcacctaccagcatacggctaagatgaggaatgatcagcccgacccagccgatactgccgctaattgccacctggcatgccactaacgaaccgcttaaaaagatcactaaccaacgtaatggggccattttcacgcccaaagccttggcttctttctcatctaaagacagtaaattcaagcgccaacttaagctgagcaaaatcgagctacacagcaaaaacgggacaaagaaaaagaggagtttttcccagttagaggtggcaaaactccccatcaaccaaaacacaatgcttggcaatttttcttctgtatcggaaatgtattgcaataggctcactagggctgaaaaaagtccgcttaaaatcatgccgataagaataagcatcaacaagctgcgttgattaaatttgaagctaaatagaaaaaccaaggcaagcgtgccgaagccgaataaaatagtgctggtaaataagccgtataaactgaatccaaagaaaattgccaaggtgccaccgaaggctgaaccggaggtcacgccgataatatgcggattcactaacgggttacgaaaaatgccttgcaataccacaccactcaatgccaaaccggcacccacgcaaagtgcggttaaaattcgaggtaaacgcacttgaaaaatcacctgttgctgcactggatcgatctcaagtgcggtcgcttttgcccacagaatttgaccaatttgcggtacagacaaagaataccgccctattcccaaagaaatcacggcggtaatcacaagcaacagcgttaagccaaagagaattttagggtaactatctggctgcattgtcgggtttgtaagaagtgcggtagaatttttggtaataatcgttcaccattttatccaaatccacgtcttggaaacgttgcggataaagggctttagccaaccatacttcgcccaatgctaaggcttccggcatcgggtatccccaggctttagcatattccggcatcaaaaaaacttttttatctttcagtgcctgaatattcgcccaaccttgatcgttcaaaatttgtggtactacatcaggataacgatcttgcaccaaaatcaccgcaggattccattccaacacattttctagagaaacctgtttgaaacctttaatggttgccgctgcgacgttataagcgcccgcatgttccatcataagccccgtatatttaccggaaccataagtgcctaaatccggatttgccatataagtgcgcacacgtttatcggcagaaacgtcgcctaggcgatctgccaacaacttacgattagcaaaggcagctttcactaactcatcaccttgttgttttttctcaaacacctcggcaatcagttcaatgccctgttttaagccgtcattataagctttatcttcgtcagttaaggttggattaagtttacctttttcgcccacttcaccagtacgcaaggaaatggctaccacagggatattcacgtcactgatttgcttgatcatttcagacggtgcgtagttagtcacaaacaccacatccggttttaacgccaacaaactttcaatattaacggaattcaaatcgcccggcatcgccatgttttccagttccggtgcaaggcgaacatagtttttgcctagttgtttcttccagttggaaagcactcccacaatctgttttgtggcatccaactgcacggcaatattcaaagtttggtgctgtaacaccacggctcggttaatgtgatcgggaattgtcactttgcgatcgagttggtccgtaataatgcgatcagctaatgctgaaaaagaaagggaactgagcaagcaggcaattaacaatgatttaagtttcatcgcacatccttattttaagtaagaaaatatcattatacacatatttatataatgataaactatgtactcatatcttttcaatcaccacctttatatcttctggcggtacataataaggtgcagaagtgataaataaacgaatacccaatttggcgtaatctgatacattatttttatttactcctccagcgacagaaagcagaatatctttctgttttgattgaagtagatctaaagcctttttcacatcctccaataaccatttatcaagttgaataatgtcgggttcagccatatacatttgctcaaattgagcataattatctgcttctaaagtaattttattttcaggtgcttcttgacgtaatctatccacaattttcgtccaatcatttggatcagaaagtaagtttcgatgattagtaaaaaccaaaagagtttcgctaacgccttgtcgatgaatatgcccaccagcggctaatacagcattcgtcgcaagtttacgcgtattaggaatacttttacgcgtgcaagccacaacagcagttggattaaccgatttggcattggcaatcatttctgcagtatattgagcaaccccacatgaccattcaagcaccaattgcaccactttccaagcttgatgtaattgttcagacattccttccgcactgatcaacaaagcacctgattcaacccactccccttcttttacatataagtgcggttgaatatccagtttttttaataatttttccgcaacagaaacacccgccacaacccctgcatttttacgcttaaacagaatttttgccggaatattttcaatactaagggcatgagtggttaaatcaccacgataaatgtcctcaagcaataaatcatccaattctttatctgaaaaataaatcatcgtaactccttaaattaattgaccctgatataactgaatctgcttacctgaaaaatactcggcttcttttggctcatgcgttactaaaattgttgtaatttcatttgtttgaattaaattttttaacactttccaaatatctttacgggaagaccaatctaaagaagaaaaaggctcatctaaaagtaataaatcaggacgataaattagtgcccttgctaaagctacacgctgttgttctccaccggacaactgatgaggatagcgattaataagatgatctatttttaattcagataataatatctgttgttcagcatcagatgctgatggattagcaagtattaaatttcctcgtaccgttttatgaggaaacaaataaagtcgttgatttaaataacgaaaatttctcttccacggaggattattttctagaacttggttattccataaaatagagccagaataatcaatataaccagcaatcgcatttaataaagtcgtttttccgctacctgattcaccaacaacagaaaggcattcacttttttcaattgaaaaagaaatagattttaaaatattagtttgaagattctgaactattaacatactaaacagccctattaatcatccgtaaaactagcaacaaacatgaagatataaataaaagccataatgatgcgccaatagcgatttcaaaatcaccacttgaaatattcaaatagactgccataggtaaagtttcggttttaaatcgcgttgcccctgccaacattaatgtggctccgaactcccctattgcgcgagaccaagctaaaactgaagcacaaaccaaaggcttccaacacataggaatctctatttttattaaagtcttaaacggtgataactcaagagtataagatgcaaatcgataacctgattcaaaggaagaaaaaataccgcgagtgctacgcatgttaaaaaccaccaaaacaaagaaaacaaaagaaataggaatttggcgaaattttacggacgtaagtgggcgggaattattgaaaacaggggctttggcggtgcattgcccctttttttattcttagggaaagaaaactaagaaaaaatcagatctttggttgatttagtcaaaatgaaccagaaaaactaagaatttaaacaaaaaagaaaacgcccgtttaaatggcgtttaaatctttaaatcaggctatgcccgatatgcactacttgcccgatgatttgtaggttttgagcattttcgcctgtaatgctgattggcgggtattcctctttgttatcgctgataagcgaaatgccgtcccattccatcttcacacgcttaacccacacactttcgccgttttgaacaaggtaaatgcggtcgccttgaatttctttgcggcttaaatctactaacatctgatcgtagttattgatagttggcagcattgaattgccgtttgcccagaatacggcgcagttatctgcttttacgcctaggcttgttagcaattcgtctgaatacggctcttgtccatcaggctgggtgataccctcgttaaaactcccaaatcctgcagaaacgttgatggagctataactatcaatcatactcaccccttcctctaacatggcttgcattctttcaaatgcacggctaacaaggcttcctgcaggcttttcttctgttgtcttttcttcttttattttaccggtcgcaagccattcaatgcttactcctgtaacttctgcaatttttacaaggttggaacgagatggatcggcttcaccttttcgccatcttgtaattgtagaaagtgttacgcctgtttttcgagcaaattcgcttgggccattcagtttatctactagatattcaatcctttctgggaaattgtcttgattttggtactgcatactaacctctttagtcgtaatagttgaataattacaactattacgggattaaaaactaaattattacccgtaatagaactaattaagtcattgtttttattcgaaatagtaaaacaatagattaaaatatagccaaatgaaactattacggtgtattttatagttgcaacatgcaactattacggataatatacaccacataaggtacagcaaaaaaggtgtattaaatgagtgtattagaaaaaccaaaaaaaaccgcagaacaggattggcaccgcgccgatattcttgcggaattaaaaaagaatggttgngcttcgctctttagcaaaagaggggcaagtcagctacaacacattaaaaacagttttggataaatcttatccaaagatggagcgtttagttgcaaatgcaattggtgttccacctgaagttatctgggctggtcgttttgctgaacgaaataaaagaccaacattacaacataagtactgattttaaccgtaaaagttataaaaaggaacatttatggataatcaaagcttaaaaacgcactattcagtgtatgaattagcaaacttaaagctaaaaacactaccttcagcccccaaaaacatttgggaacaagccaagcgagaaaactggaaatctcaaaaacgccaagggcgtggtggcgggctggaatatgaattagccagtttgccaatcgaagtgcaaaacgagcttctgctcaaaactaccccagagcaaacggcggtagctttgcaaaaaatagaagaaactcgaccgcttgcaagcaatgaagtctggcaattatgggacgaagcaagtgcaaaagcccaagagcaagcaaaaatcaaacttggcacgatgtttgcagtagcaaatttagtggaaagcggtgtgaacgtgttagatgccttccggcttgtctgtggcaaagaaaatgccgaacggctgaaaaataacgaaaaattactctcagttggttctttaaaaaattggtggtatcgggtcaaagacgccccacggcaagattggctgcccttgatgctcaacaacagcggcaagagtagcaaaaacgtggcagaaatagatgaagctgcttggcagttcttcaaaaatttctactacagtcgtgaaaaaccctcactggctcacagctatgaggtattaaaacaagccgcacaatacaacggttggcgcattccctctcgctcttcgctaaaacgcaaaatggaacgagatgtaccaaaaaccgaagaagtgttccgtcgtgaaggccaatacgcattaagtcggctttatccctcacaggttcgcaccgtggcaatgttacaagcgatggagtggatcaacggcgacggttatcaacacaacgtttgggtgcgattccctgatggcgaaattaaacgcccgaaaacatggctttggcaagatgttcgcacccgaaaagtgctggccgctagaaccgataaatcggaaaacaccgacaccatacgcctcagtctgcttgatgtgattagtcgctacggtttgccgaaacacttaaccatcgacaacacccgagcggcagccaacaagaaaatgacgggcggggtaaaaaaccgctaccgctatcaagtaaacgaaaacgaagtgcaaggcattattccggcactcggtatcgaactgcactggacgtcgattcaattcggcaaggggcgcgggcaagccaaaccaattgagcgtgccttctctcacggcggtttgggagattatgtcgataagcacctgttattacgcggggcttatgcaggggcgaatgcctacgaaaagcccgactatgacggcaaaaacggcgcagaacagcctgtcgattacgccacattcttaatggcattagagcaaggcattcagcaatggaacaacgtgggcaaccgcctcaccgaaatttgtgcaggcaaaagcagttatgccgaagcctttgagcgagattgggctgttgccgaaaaacgcccgattagccaaagccaaatgcggttgttgcttaccctgcatgaggaagttcgccttaaccaagacggtaccttctacctaaacgcaggcaaaatcggtacgaacaaaaaccgctatgagtnactggcgcttatcggtacctcacacaaacgcgttgtggtgcgctacgacccagccaatctgcacgacaaagtgtgggtttatgccttnacgggcgaatacttggcggaagcggaaatcaccgaaaaagcaggctttggcgaccaaatggcaggacgcgaacacaacaaagcaatgcgcaactgggtaaaacataccgaaaaagcggcgaaagaacgcgctaaagcggaagaaatggaactcagcaattacgccccggcggtcgaatttgaagagcggttcttggaaatgttgccagagccggtaaaagcccctcaaacgcaagcagaagaggtggaatatgaagaagtgctagatttcaacaccgtgcgaaaagtaccgaaagcagtggaagtagaagccgaagaaatcagcgaatttaatcgtgattgggaaaagggtttagagcttttaaagaaaagtaaagggcgttaaaccaaccgcctttaaaccagatttaaacagggtttaaacgccctaaggagaacaagatgagcaatatcacattaaacgaaaacgcaatgctttatttaaaagcagactattatcgccctgaaatgcccacttttaaagcctgctatttccgattaagcaaaattgcccaagaacaaggctggggaacattgccgaatttagcccaaaccaaagccctgtttaaagcggcagtccctgagattatttggacgagagaggcgtttaagcgtgccaatactcaaaagaaacacgcacataaggcaacgccttatcttgaacaagtaatgtaattcgagcagcaaaactctcaggtaacagcacataaaacggagctggcaagttagataaatcaagtggttcagagcctattttgttcaactctaacacttgaagatggcgagatttcaattttgcgattagttgatgaagaaatgctgaacgtgaattacccaccacagcttgtaacgcatcatcaagattaagccaagaggcagaaccgtgagcaggcaaggcttgagcaaattttaaaaactgcttatgccaattttcttcagaaagcaatgaggttggctctttttgtacagaatgttcaagtttagtaatcacttctgaaaattcgtgaaaaagtgttgccacggagtagagcttaacaggttggcgaaccatttttaacagtaaatcagtttcagacataacgcccccaaaggtaaaaacaggaaacccattatgacactaatcaacaaactcaaacaacacttaagcgacagccaaatcacccaagcccagcttgcccgcgaagcaggcgtaaatgcaggtgcattgtcggcataccttaacgataactacaaaggcaatattgcagatgtggaagcaaaactggcagcttaccttgagaaaaaagcggtgcaagcccgcgagtttgtagaggcaccagcctttatcgaaacagcgacttctcgtcaaattttcaaaacgctggaatttgcccaaatcgccaactgcttagcgactgtttacggcatgagtggcgtaggtaaaaccaaagcgatccaagagttcgccaaaagtcacgctaacgtgtggctggtaactgcaagccctagtcgttcaagtttaagcgaaattttgtatgaaatcgcccttgagttaggcatcagcgacgcaccacgcagaaaaggcacactctcacgcctgattgctcgcaaaatcaaaggcacagagggcttgctgattgtggatgaagccgaccaccttccttatgaggcactcgaagaactccgtattatgcaagaagaagccggtattggcttagtgttggtaggcaacgacaaagtctatacccgaatgaaaggcggtattagcccaagccacgaatatgcaagattgtggtcgcgcgtggcaaaaaacaccagcattcagaaaactaaaaaagcagacacgcaagcagtcgctcaagcgtgggggttagaaaccgacgaagaagccttaaaagtgatgcaaagcattaccgaaacaggcggtggtttgcgaattttaacccaaacctacgcttgcaggaatggtagcaaaaggatctggcaagttgattgatgccgacttaatcattaaagctcgccaagagttattaggaaaaggcgaataggaagatttatgcaaaaagtctacaacaaaatggcaggcgaaatgatgagccctcgcaatgccgttatccataaccaattagctatgcttgaacttgccacacttgagtgcgaagcattaggcattgaagtggaaaccgtcgaatggttcgatattggtaaaccccgccttgtcgtaaaagattgctcagctttgcgccatttaattaagactggtaaagcctttaattatggctcagaagtgaaaaacggcatccgtatttacctaaatcaaatgatggtaaaaggcgtaaaatttatttggaaatcagatgtaactaaacattaaccacaggagaaactatggcaacgaaagtaaaaagccaagcgaaattacgctttgtaagcgtagaacaggtgcaaagtgcgattaaagaaattggcgatttaagccgtgaacatacccgccttgcgaccgagatgaacgacaagattggggcaacaagtgaacactatgctccgaaattgaaagccttaaaagaagagattgagccattgcaaaaggcggtgcaggaatactgcgaggcaaaccgtgatgagctgaccgagttcggcaaaaccaaaacggcgaattttgtgacaggtgaagtgcaatggcgacaacgcccaccttcagtcgctattcgtggggcggaagctgtgatggaattcttgcaacgtatgggcttcgaccgctttattcgcaccaggcaagaaatcaacaaggaagcgttgctcaatgagccagaagtggcaaaagggattgccggcgtgacaattaaacaagggctagaagattttgtgatcaaaccatttgagcaggatgcgagatgatggacgatttacaagatgtaagcagattaagagaagcatatcagttttatcaaaaagcaaaacaagatgaagattcgattgtttgcggttgtttaaatgatgcgtatgaatggctcttcagtgaattgaaggcactgtttgatgaggaggaagaatagtgaaactaaaacagaaacttttaacgtttccaaacgtatgtttattgcttcttgtaatttgtagcacgctaggtttagcactggtttggtttattccatttgttggtcaagccttaatttggaattccctcgtttttctatgctgggtggtttatttcgaggttcgtggcttaaaagattggggcgaacacaatcttgagcaattagtaaagatggctgaagtttccgcagcagcagcttacaaaattagcagcatggtggcaaagtgataatgaatggtaaggagatgtaatgagtgcctctgtaatttgcttaatcgttgccagcgtactatcgcttatcgtgctgtatttagaacaagattaaagcctatttaaaagccctttaaaaatctcccctaccccctctttgcaaaagagggagacggattgaggggctttcaaaatatgttttaacccacaggagaaaccgatgaaaaccaaacgaccacacgccaaaagcgtggaaaacttcaaccgctaccgcttttatgcggagaaagcggcaaaagaagaacaagccggcaactacgaagaagccgaaactcattgggatttagcaatgctttctgccagccccgaaaacaaagaatgggcaatccgccgacgcgatttttgtcaacgtatgcatcaaagaccatttgagggggaataatgatgactgaaacccgtaaaaacgagctagaaaaccagctaaaccaaatgattgtgatgctaaaagaagctcaaaaatctttgtttaaagggcaatacacccacgcagctatttttgtggggaatgtgtcggatcagttgccaaatatgcgaatgatgttagcgagggggtaaagatgaatgcaatccaatttagatattttaaaggcgttatgactaaagagcctctaaaaacgattatcgacacttggtacaaattaagagctgaacgagataaaaagctaaccaacatatttaatactatccctttttatgaaagctggttaggtgatgaaacttctatttttggaatagtttgcagttatgacaatccagctcgtgatgaggcagtattaacaaaaggatacagaactgaagattataaaggaaaatgtgtggttaaacctgatagacgttataaggttggcaaggattttgacaaaaaactacaggctattcgacaaattttaaaggaagcccctgatttctcaagttattcgctaaaagagctgggtatgtatttgttagttggtaattttagccgactttatttctcagtatctggggttcaagatgatatttatatcgcaaaaattccagttaaagagcaaggtaattttggtgatgattttttagaaatccacgaatgcttaactgaaataaaagagagtgaatttctttctattcaaggcttataacaaggaggcaactatgtaaccgcacaataaccgctgcccacaccattccatctaggttgttataactcggtgtgggcaagtttaaagggtgtttaaattttaaagtaaatcgtttaaagcctgtttaaatcagctttaagccagttttaaaggattgactaagaggacacacaatgagcgaaaaagccaaactaatccagctgatccatattggcaaacagcagcttaatatggacgaattcagctaccgcgaaatggtcaagcgactgaccaataaaaccagctccaccaaatgcacggtggtggaactgctcaaaattctgcacgaaatgcagcaaaaaggggctaaagtgaaacactttgcaaaacgtgggacaaaaccaaccgcttacagtcctgctacaggcgaagttaaggtgaaaagtgaaattgctcataaaatccgagctgtctggattcagatgggtaagcacggatttttagctgacccaagcgnaaaagccttaaacagttatatgcgaaaagtgatgaacaaaggaaaaagtgtgcttgcactcaatgtaggggcgttaaacagcaacgatgccagcagatttttggaaattctcaaaaagtggcataagcgggtaatgcttaaacgtcttgctgaaaaatatgggtgcattacaagtgctgaaacaggctatgatgaactttgtttagtatttaaaaattatcagggggtagcatgaaactctgtcgttgccctatttgccacagtgatattcacttggaagcccttattgaagatgatgccggtcgtgaattattaggcaaaattagtcaacttacccacggttgtgcccaaccgatggttggttacttaggcttatttaagccagccaaaagcaacctcaacaacgcccgagctttgaagatattgagcgaagtgttagatctctacccttgctcgctgcttttggctcaagccctcagcgaaacggtggcaagcctgcgcaaaaaacgccaacaagccttgcaaactgggcagaaaattgaaccgctaacgaaccataattatttaaaatcggtgtatgagactcaaaaaccacactttgctgtgattcgctccggcaaaaatcagtcagaaaccgtcaaagcccaacaagcggaagacaaaaaagtgcaagatgcgattttatatgtcgaacggttcgtacaattagggcaagaagagtttgtgaaaaacagccctgaatatcaaatctggctgaatcataaggcacaaaaacaagccctttaattctccctcaaggcggtcattaccgccttttttcttgccttaaactcacccttttagacttttttatttctcgccagtcctttctatatcagctttaagccacttttcggcttgtattaagaaaaattgtgctagtgggaaattttaggttttgtacaataggcacattgataaattgaattgggtaagctatgtcgcaaacattacaacaaacaggattatttgatgatgaacacgctgatattggtgcattgttcgaccatttagaccaaatccccagcgtagagttagaaaaacgttggccatcgctattggtggaggtaatagaggtaatgcaagcggagtattgcgccaaaattttgcagaagataaagcaaaaaagaccgcttcgaagctcgtgggcgtaatggctcactattttggcggtaagtcgttttatctgcccgcaggtgataaaatcaaagaagccttacgagatgcacaaatttatcaagaattcaacggtaagaatgtacctgacctaataaaaaaataccgattgtcagaaagcacaatttatgcgatcttacgcaatcaacgaacgcttcaaagaaagcgacatcagatggattttaattttagttaggtggtcttatgaaattactcaaagcattagctgtattaagtttagcgacaatttcctctcactcatttgccgtagatgggtttcaaaacgtaaaattcggggcatctaaaaccgaagtaagaaatgcgtaccagaaatgccaatggcagaaagatgaatacgatcttttttgcccaaattttacattaggtgcgataaaagatactggagcatatttttattttattgatgataaatttgaacgtattgctattaacattccaaatgtgaacattgatggcatcggacaagctctaagtgaaaaatatactctttcatctcaaccgacacagagagaattagccaatccaaaaccgaataatgtgtatgactttggatttgataaagataccatcttaatccgatatacatatgacaacgatatgactgaagagatttttctcatttatactacacctgattttaacaacaaattacaaacaaaggacgcccaatcagttaaagatcaactctagtgtgatgactcacaaactcaccccataactcaatcccctaaactccagttattaaataatccttaataactggagttttttatgtctttacctatcaccaaaattgttgtgcattgctcggcaactcgcaacggcaaatccattaaacaaccaggcaaaaatgccgcacaagtgattgacggctggcacaagcaacgtggctttaaacgtcagctttcatcacaacgtgcatttaatccgcacctatcttcgattgttatcactttgtcattgatgtggacggctcagtcggaaccggtcgccaagtgggcgaaattggtgcacacgttaaggggcacaaccaaaattcagtggggatttgcttagttggcggtattaccgcaagcgggaaaaatcacggcgaatacaccgaagcccaatggcaatccctgtacaaactcttgcaagaactggaagcagaacacccgaaagcgcttatttgtggtcatcgtgatttatcaccagaccttaacggcgatggggtcattacccctaaagagtggctgaaagattgcccgtgctttgatgtgtggagctggttggatagcgagcaagtggtcaatcttgaccatctttacaaggagtaacaagcggtgggattttctgaactttttactaatgcagatggacgactttccactactgccagcmttcaattttggggcttcgttgctgccactggtgtgctgttgtactcggtttatttagataagccctatgtgccggaaatgttcagcacctttttatttgcctgtgttggcactgctgccaccaaaggtgtggcaaatgccctttcacaacggagagaacaaggaaaagagcaagggagagagcaagggagagagcaagaatgatgaatttaattttagccttttctggtgtgattgctttatatggtgggtatctctacctacgtttacgtcaaagccaaaagcaagcagccactttacaaaaagaaaaagaacagttgnaaactcaaaaaactgttgccgaaactaaagttnaaaattaccaagtgaaacagnaaaatgaagaaaaccttattagccgtagccgtactagcctgcttgagcggatgcacaacgatggcgacctccgtgattaaccccagttgcgcgggttttagcttaatcaaagccagcagacaagataccactgaaaccctgcgacaggttgctgtgcataacgccacctatcgccaaatttgtgaagaacaaccctaatggcagatgtattagaccaattaaatgagcgagaagaagccctcttacaaaacattctcgccccacatttagataccgaattgagcgatgatgaagtggacgcaattgccgaagctggtcgccaatgtagcgaatgtggcttgcccattcccactacacgcttgcgtgcgaatccattcgctcaccgctgtgtaagttgccagcaagattgggaggaaggacgatgattagcgaattttgggaatttgtgcgatccaattttggtgtcatttcgaccctgattgcgatttttatcggggcattttggctcaaactcgacagcaaatacgctaaaaagcacgatttaagccaacttgccgacattgcccgcagccacgataaccgcctagcaacactggaaagcaaggtggaaaatttgccgaccgcagtcgatgtagaacgcctaaaaaccttattaaccgatgtgaaaggcgacaccaaagccacttcacgccaagtagatgcaatgagtcaccaagtgggcttgttattagaagcaaaattaaaggaatgatgaaatgtcgtttaaagaattgattactcaagaccaacgccttgtggtattacgcgtactttccgaagccggctatgatgccaacgagtcgattattaatgatggcttggatttatacggtcacgatattagccgcgatttagtccgtacccatttgagctggttagaagagcaaggcttactcactattgaacgcctaaaagatggctatatggtggcaagtattacccaacggtggcttagatgtagcacaaggtcgtgtggcagtggaaggcgtaaaacgcccccgcccgaaaatttaaacaccgtttaaaggaggtttaaatgaatgacaaaaccacccgagggcgtgccagcaaggttgatttattgccgccaaacatcaaatccaccctcacgatgatgttgcgtgataagcaatactcacaagccgaaattctggaagaaattaacaacatcattgcagacagtggcttagatgaatcaatgcagctttccaaaaccggcttaaaccgttttgcatccaaaatggaacgttttggcaagaaaattcgtgaagcccgtgaagtggcagaggtctggacaaaacagttagtcgaagccccacaaagcgacattggcaaactgctgatggaagcggtgaaaaccatggcattcgacttaaccctcaatgccgatgaagccgtggcaaacgacccgaaatttttaaatcagcttgccctgatagccaaccgcattgagcaagcccaaagtattagtgaagagcgagagcgcaaagtgcgcaaagaagtcgcccaacaagctgctgataccgcagaaaaagtgattagtcaagcaggcttatctgccgatrcggtcgcccaaatcaagcaacaaattttaggaattgcctaatgcaaaccttacccgatttaatcccctttgacccaaatgccttactgctcggctatcaaaaacgctgggtggcagataccagtcagctcaaaatcgccgaaaaatcccgacgcaccggtttaacctgggctgaagcggcagatgatgtgatgattgccagtcttgccaaatcagagggcggttcagatgtgttttatatcggctctaataaagaaatggcacgcgagtttattgacgcctgtgcgatgtgggcagcccaatttaaccgtgcagcagggcaaatccaagaagaactctttaacgacgaagataaagacattctcacctacgtgatctactttgcttccggttttaagattaaagccctttcttccaacccgaaaaacttacgcggtatgcaaggcgtcgtttgtattgatgaagcggcgtttcacgagaaattggctgaagtgctaaaagcggcactcgctctcacgatgtggggtgcaaaagtgcggttgatttccacccataatggcgtagataacctgtttaatcagttgattcaagacagccgtgcggggcgtaaaagctattcggtgcataccatcacccttgatgatgcttgtgcggagggcttatatcaacgtatttgccaagtcagcaaacagctgtggacgcctgaaaaagaagctgcgtggaaagctggtctgttgcgtgaaaccgctaccgaagacgatgcactggaagaatactactgcgtgccaaaagccagttctggggcgtatattccccgcccaatgattgagcgtgcagcgaccgaaggcaaggccaaactgcgttttgagtgcgatgccaaatttatggaatggacggaagacgaacgcacagtcatcaccagtgaattttgtcttacccaactattaccgcacctgcaagccctcaaccctgaccgtcgacacgcctttggggtggattttgcccgcagtgctgacttaagcgtttatgccgtctgtgccgtacaacccgacaccgcacgccattttgacttaacgctggaaatcaaaaactgcccatacaaccaacaaaaacaaataatgctgtttatgttggcaaatctgccacgccttattggtgctgccttcgatgccaccggcaacggcggctatttagcggaagcagctttaattcgctacggcagcagtatggtcgaagccgtgcaactgaatgaaaaatggtatcgggagtggatgccgaaatataaagccttgtatgaatcaggttatattcaaattccgaaagatgaagaaatcatcttagaccacgggcatatacaggtgattaacggtgtgccaaaaattgacaaatcacgctcaaaagataaatcaggcaaacgccacggcgatagtgcagtggcgtattgtatggcggtgcgtgccagttatatgacaggtggagagattgatttcatacctctgcccgataaacattcagaccgcagcgaaaatgatgaatttgatgactttatatccaactgggactggtaaggataacgaaaatgcaaagtagaattttagatattcacggcaaccccttccgctttgaagctgatatgcaaaccgaaagcgaaagccgcttaatgccgctgcaataccattacagcgaccacccagccagtgggctaacccctgctaaagccgcacgcattttacgagcagccgagcaaggcgatttagtcgcacaggcagaactcgctgaagatatggaagagaaagacacccatattctttcagaacttagcaagcgacgtggcgcaattaccgccgtagattggcagattaagcccccacgcaatgccacgccagaagaacagcgtgatgcggaaatgttgcaagaaattttagaagatgcagtgtggttagacgattgcatttttgatgccactgacgccattctcaagggcttttccagccaagaaattgagtgggagcaaggcttagtcggcggcttaaaactgattaaaaacgtgcattggcgtgatcctgcgtggtttatgaccccagcttaccaacgcaacagcctccgtctgcgtgatggcacgcccgaaggggctgaaatgcaacaattcggttgggtcaaacacgttgcccgcgccaaaacgggctatttaagccgtatcggtttagttcgcactttagtctggccattcatctttaaaaactattccgtgcgggattttgccgagtttttggaaatctacggcttgccgttgcgtttgggtaaatatcccgaaggggcaaccgacaaagagaaacaaaccttactgcgtgcggtgatgagtattggacacaacgcaggcggcattattccgcgtggtatggaactcgaatttgaaaaagcggcagatggctcagacagcacctttatggcaatgattgaatgggcggaaaaatcagccagtaaagccattttaggcggcacactcaccagccaagcagacggggcaaccagcactaacgcactcggcaatgtgcataatgatgtgcgtttagaaattcgcaatgccgacctaaaacgccttgcagccacccttacccgtgatttggtctatccactttatgctctcaactgcaaatcatttaatgacgcccgtcgcatcccgcgctttgaatttgatgtggcagaaagtgaggatttaaacgcttttgccgatgggctaaacaagctggtcgatattggcttccgcattccgaagcaatgggcgcacgataaattgcaagtgccaatcgctactgaaaatgaagaggttttggcaaaatcttttcaaaatccgaccgcttatatgcacagcaaagctgacggaaaaatggcagtattatcggtgcaacccgacccagaggatttgctggataacttagaacccacggcggaagattaccaagccgttatcgatccgctattgaaacccgtggtcgaagccttgcaaaaaggcggctatgaatttgcacaggaaaaactagctatcctttatgctgaaatgaatgatgaagagctggaaactttgcttactcgtgcgatttttgtcagcgacttattaggacgtgccaatgccaaacgataacaacacgccacccgatggcaacgacattgatatgggctatgtctacgcctagagccaaaactggctgtcgattacctcaaatcaaaaggcgtgaatattacttggaactggtacgaacagttagaaagtgcgcacgcccgtgcatttaccgtagcaaaagccactaaagcggaagtgttagataccatccgctgggcaacggaacaagcgattgccaacggcaccggtgagcgggaatatatcaaaaaacttgagccaatgctcaaggaattgggctggtggggcaaagccaaagatgaaaatggcaacgaagtgcaactcggtagccctcgtcgcttacgcaccattttacgcaccaataaaatcaccgcttaccacgctgcacgttacgctcaacaaatggaaaacgtggacgaacagccttattggcgctatgtagccgtcaatgacagccgcacccgagccagccacttagccctgcacggtaaaatttatcgtgcagacgaccccatttggcagacaatgtatccgccgaatgattggggttgccgttgccgtgtggaagccctgagtgaatatgccgtacaaagtcgtgggcttaaaatttcaagcagcgatggcgaaatggaaatggaagaagcggtggtcggcattgataaagacactggcgaagaaattcgcaccacggtgagcaaaatcaaaaccgaccaaggcgaaatgaaagtgggcgctggttggaactataacgtgggttctgccgcctttggcactgatgtggccgtgttgcgtaaattgcaacaggtgaaaaatcgggagttaagacagcagactattcaggcgattaacaacagcgaagcacgccataaagcctttgccgattgggtgttggcaaatttgggcaagcgaggggcaagtgcaagatatatgtcggctgggttagtgacgacagaaattgcggaagctgtaacagaaataacccaaggcggaaaaaatgcagaattggttttagtaatgtcagaaaaacgtttggcccacgcaaatagtgataaacatcacgaaggcggtgtcggactaacagctgaagagtatgcgtctatttctcgcattgttgcaaatccaagccttgttttatgggataccctagaggggcataataatttgatttacatcaatcaagaacgaactattcaggtaattgttgatgtgccaaataaacactcaattaaacctaaggaaaaagtagatgcaatcatcaatgcttataaagttgatatgaacaacgtgaaaagacagctttcaggtgggaattatgtattgcttaaaggaaaactgtaagtgttatggtgggggttgaacccacgatatacatatgccattaaagaatgggaatgccgcgttaccatttcgccacataacactcacagttttagttctgttcaatttacgcccaaatatcaggaaagtcaaattatatgcacattgaatataaattcgataccagcactattcagcagaaatttaaaaagctagcgcaggtgatggacgggcgagatattactcgcaaagtggctggcgtattacgccaagaagccgagaaattctttgatctagagcaagcccccacgggtgaaaaatgggaagacctagatgaagattacaaaaaatatcgatacgcagcaggtcacactggcaaaattttacaaatcagaggcggaagaggtttggctggtagtttaagtttagattatggtgataattatgctttaattggtgctgctgaagagtatggtggtttccatcaactcggaacaacatttatgccggcacgtccattcttagggctaggcaaagacggcgtcagcgaaattaaagcgattttaaaccgagagttgtcggaattaactcaagaataggctaaaatcgcaaatatcgccacagaatcacgctaagggcgtttgaaaatcaatttatatcattttacgtctcaaaaaatttaaacgtgcttaaacgcatttaaacggcatttaaacgctattctaatttaaacctttctctaattttccaccgctgactttcagcgttttattttaggctgatatatcacaaatccgcccttccctccctttaccgcaaaatagcggttatgaaagcagaaaaaacctctttagcggtactcaccgcccaacttaccagccccgacggttggcagcaacttctccccaagggcgaatttcgctcacgggacggctcgcccaccgacgtggcgcattggtttattgatggaacgattgcccaaaaccttatccacaaagcccgacagcttaatcaagatttactcgtggactacgaccacgaaacgattttgaaagcgaaaaaaggcattgacgcaggcaacgtggtggcagcgggttggtttaatgccgatgaaatccaatggttcgatgatgaaacacggcaaggcttgtacatcaaaccccgttggacgccaaaagcctatcaacaaatcaaagatggtgaatttgcttttttaagtgcggttttcccctatgacgaaaacggcacgcctcttgaactccgaatggcagccctaaccaatgacccaggcattactggtatgcaacggttagccgtgctttcggcaacccttaacccacaggagaacgtcaaaatgcctgaatccttacgcaaattactggcaaaactgggtgtagaaatcgcagaaggtgtagagctaaccgaagagcaagccaacaccgctttaaatgcccttgaaaccttgcaaaccgacaaaaccaaagccgatgagcaagtggcaactttaagtgcaaaaaatactgaagtggatctttcccaatatgtgccaaaagcgacttatgacgcggtaatgagccaagtggcggtgttatcagcaaaaaccgatgatgtagaaatcgacaaccacatttccaaagcccgtaacgaagggcgtgcagtggaagccgaagtggaatacctcaaacaatttggcaaacaacaaggtgtggcagctttgtctgcaatgttggaaaaacgcccacaaattgccgtgctatcggcgcaacaaacccaaaccaccaaggtggaaaagcctgttgaaaaaggcactgccgtgttaagtgctgccgataaagaagcagcgaaattattgggtatttctgaacaagattacgcaaaagaactggaggcgaaataatggcaaacgtaacccctgatttagtcaaagccctgtttgtcggttttggtaaaaactttaaagacgggttggcaaaagccccgagccaatatactgaaattgccacagtcgtgaaatccactaccgcaagcaatacttatgcgtggcttggtcaaatgccagggctgacagaatggattggcgaccgcaccttaaccgcgattcaaagccacggctattctatcgtcaataaaaaatgggcaaacggtgtagaaatccaacgcaccgatattgaagacgacaacgttggcgtatatagcccattgattgaagaattaggtcgtgctgcaggtgaaaaagccgatgaattagtcttcggtgcattaacggcaggctttaaaacagcgtgctacgacggtcaatacttcttcgataccgaccaccctgtgggtgcgaatgtcgatggtactaaccagaaatcggtgagcaacattaccgatgacagtacaggcgtaacagaagctaatgcgtggtatctcttagactgttctcgcagtttaaaaccgattatctaccaagaacgcaaagccccaacaccggcacagattaccgatgccaacgatgaaaaagtctttatgaaagacgtgtttacttacggtgtggattctcgctcaaatgtaggctatggcttctggcaaatggcacacgcggtgaaaggcaagctgactgcggaaaatctctggaaagcgattgaagcgatgcgagcggtgcgtggtgatggcgataaacgcttggcaattcgtccaacgcacattgttgtgccaccttctcttgcgcaagcagcaaccaagttgcttgaacgcgaattgcgtgccgaagatggtgtagcagtcgataacgagttcaaacgtatgaacttgaaattgattgtgggcgactacctctaatcaactacaagcggtcagatttgccaaatattttacaaatttgaccgcactttaaacctgatttaaagaggatttaaatgcgatggataaaacattttgtgttgtggtgcaaaaccggattaaagaaggctatcgccgtgctggtttcagtttccaccttggggacaattcgcttgcagctgtgtcagaaagccagctcgcccagctcaaagccgacccacgcttggtggtacaaatcaccgaaacaggcagtcaagaaggtggcgaagggttatcaaaagagctgcgggtagtgacgaacagaaacaacttcgtgctgatccaccatcaaccgatttaaacactttcacagtggaacagttaaaagcccaactcaccgaacgtgggatcacctttaaacaaagtgccactaaagcggaattgattgcgttatttgctcccgccgatggtgaaaaaagtgaggcataacgatggtgttatatgccaaccgtgaaagcctgattaarcgttacactctcaaggtgcttgagcaaatcgcttggctacccgaagsgcaatcgctggacgaagccaaagtgcaagaagccttagaagacgccagtcaaaccatcgacagttatttgggtggtcgttatgtgttaccactcaaaactgtaccagcagtgttagaacgccattgttgctatatcgctcgatactttttagagaaaaatcgcgctaccgaccaggcccgtcaggactatgaagacacaatccgttttctggaaaaagtcgccagtggtgcgatttctctcggtttatcagacgatgatgaaacggtagaaagcgaaaatggcgcaatgatggaaagtgctggcagcgtatgggggcgcaatacctcaaaagggtttatctaatgagtgtcattgctgaaaccaacgaggcactacttgctaaaatcaaagccctgtgtggggattatctgcgtgaagtcgatacccacccaggacaatgggatgacagttcagtccgccgtttagtgcgtaatccgcctgccgtttatgtggcgtggttggggcaacagcccaacaataatccccacacagtgaccgcccgttggggggtgtttgtggtggctgaagtgttaaacgggcaacgtcgcaatgccgtcggtatttaccaaattgtggaaaccctcaccgcagggctacataagcaacgcattgcgcccagcggtatgtttgaattgcaaacggtgcaaaacctgtggtcagatacccaaagcggaatgggtgttgcggtttatggtatgtactttaacgccgtgcaacctttgccggatatgacaagcgatgacaccttgtgtgattttaaaatttatgatcacaccttcaaccaagataaagatgaacacacgattgacggcaaaacccgcctcacagtggaattgccaacgcaatcagattaaacagggggcaatatgccaacatttaaaattaagcctaaaacaggattgctgattcgagacccagagacctttgagttgttaagcgaaagcggtgaagataagcccaaaatcagctactggctcaatcatcttaaaaatggcgatgtggagctggtcacagaaaccaccacaaaagccaaaaatagcaacaaggagcaagcctaatgtctatttctttcaataatattccgtccgctttgcgtgtgcctttaacttacattgagtttgacaatactaaagccgtgagtggtccccccaccgccttgcacaaagtgttgatgttaggcacaaaacttgccacaggctcagctaaagctggtgaagcggtgcgcgtgtcagcgtatgcacaagccaaaaccctatttgggcgtggttcacaactggctgaaatggttaaaacctttaaagcccacaacagcacacttgatttatgggtactccctcttgatgaagcgccaagtggggcaaaagccacaggttctgtgcaaattaccggcaccgcaactcaagctggcacttttagcctgatgattgcaggtaacaactacaaaaccgctgtgaccagtggcgatacagcagatgtggtcgcaggcaaactgcaaaaactgattgccgcagaccaagatgtgccagtggtagcaaccgtcgcaggcaacaccattacgctcacttgccgttttaaaggcgaaaccggcaatgagattgatctgcgctgcaattactactcaggcgaagccttccctgaaggattaaaagccactatcactgatatgaaaaacggtgcagtcaatccggatatgtcagtggcaattactggtttaggcgcagaatggtggaactacatcattaacccgttcaccgataccgaaagcctgaatttactgcgtgccgacttggtaaagcgctggggaccattaaaacaaattgacggcatctgctttatggcaaaacgtggtacacacgcagaagtcaccacctttgctgagcaacgcaatgactatttgttcagcttgcttgctacccataaagccccacagcctgcctatctttgggcaagtgcttatgctgccgtggttgcaggctcgcttgctatcgaccctgctcgtcctgtgcaaaccttggtgatggatttactgccaccgagtatgtcagaccgctgggacttaccggagcgcaacacgcttttgtatagcggtgttagcacctatacggtcaatgcaggcagtcagccacaagtggaagcagcaatcacgatgtatcgtaaaaatgcctttggcgataacgatgaaagctatctctatgtggaaaccatagccaccttgagttatttacgctacgccattcgcagccgtattacccagaaattcccacgccataaattggcgaatgacggcacacgcattggaccggggcaagcaattgttacgccaaaaattattcgtaatgaactcttggcattgttcactgagctagaatttgccggcttagtcgaagactttgagcagtttaaccaaaccctctttgtagaacgtgatagcaataatccgtgccgcgtgaatgtgttatccaacgaaaacctggttaaccagttccgcatttatgcacacgccattcaatttattttgtaaggagcaacaatggcaacacaatttcaaggctcagcaattattcgcctcaatgggaaagaatggccgtccgacaacgacggtacgctcaccccaggtggcaaagagcgcgaaaccgtcaaaggttcgcgtgtctatggcttttctgaaaaacctactgaagcaatggtggaatgtaccgtgtttaactgtgccgaaaccgatgtgatggaattacaaaatatcaccaacgccacagtggagtttgaaactgacattggtcaagtttatttgctccctggtgcatggacagtagagaccggcacgttaagtgcggacggcaaaatcaagctcaaaatggcttcgattgaatgtaaacgtgtgcaataagggggaatcaaaatgaaattgatgttagaaaccggcttaatgtttggtgaagaagcccaattagaagtaacaatgcgtgaacttaccacgggtgatttactcgatgctgaaatggcagcagaacgtttagtgatgacccccgagggcgaggcagtgttagccaaatcccctgcgttattcggctatgagctsstccgccgtcaaatcgcttcagtaggcaaaattaacggcccgatttcgatgcgtcagttacgttcgctcacgaccgaagatttaaaccgcatcagcctttatgcgcaaagctgggagtcggccaaagcagaacaggtggtctcgcgggggcgattggatacagcagatcaggaaactggaaaagacctgtctgctgttagctaagcattatcagtgcaaccctgtgtggttgctttctcaacctatctttaacttgccacgctatattggctacataggaggcaatgatggcaaataactctacctcgttttttgtcaatctagcgggcaacgtctcacaacaagcggcacgatttagcaattcgattgccaatatggcaaacaaaaacgtgagcagcctgaacaaggtcagtcgtgctatttctgcggtttccaagggctttaatgggctgggaaacatcactatccctatcattggtgtcggagcagcagctggtgcgaccatggtcgggaaatcaatgttgcgtaccgccgctgatttcgagatggcaaaaatccgaatgaagcagacctttggtgagcaaggtgaggctgccgatgcgtggcttaaaaaattcgctactgataccccaatggcatttgccgacacccaagatgcaatgatgcgtctgaaaaccgctggcattgacccgatgaacggttcattgcaagcccttgtggattataacgccaaagtgggcggcgataaggcaaacctagacggctatatctcggccatcagtaaaggttttatcaaaggcaagctttccatggaagaaatcaaccctttgcttgaacgtaatgtcaaagtatttgaaatccttgccaaggaaacaggtggtaaatacaccgcagaccaaatgcaaaaaatgttacaggaaggcaaactagggcgtaaagctatccatgccttattgcgaggtatgggacgcgatgctcaaggggcagccaaggaacagatgaaaacctgggacggtttagtatctaaccttgaagatacttggacgtcgatgcaggcacgctttatggaacacggtgcttttgatgccttgaaaaaggaactaggcgattttgttgagtggcttaacgaaaaaattgatgatggcacacttgatgattttccgaaaaccgtcagcgacacgctgattgaagccctaaaaaacctaaaagagatggcaaaagacgtgaagcctgttttagagagtatcggctcggtcatgagctgggtctctgaaaaggctggcggttacggcaatttagccaaatttatgggagccttatacctcggtaataaagtgctgcgtaacgacaaagtgcaaacgctaggcggttggggctggtcgggagctaaatggggttataacaaaatcttcaaccgtaaaaaaggcggcgcaggtggtttggctgatggtgtggcaggtgcattaggagctaccgtaggcgttacccctgtttatgtaaccaacttcccgatgggctttggtggcggtggcggtggtggttatggttacgatgtcattgaagatgggcgtgataaagataagaaaacccaaaagaaaaacaaaccaccaagaccaaaacgaggacgtggtagtgtgcgttcccctgttgcagcagtggcagcttctgcggctgccgtgcctaaggttgctgcacctgttaccactgcctcaagcggtgtggcacgttccgtgggcaatggcgtgaaatctttagggcgaggggcatcaaaagccgtaccttacctaggaacaggtttggcagtggcagaaggtgtcaccgtgttgatggacgataccaccaacaccaaagagaaatctgaggcgattggttctatcgcaggtgccactgctggggcgatagtcggacaagccctgattccaattcctgtagttggagctgcagtaggctcttatttaggtggttggctcggcgaatggttaggctccgaagtcggagagtatctttctgatcctgaaccgattaaaaacgagctaaacggcacaattaacattgcggtgaaagcctctgaccaactcattgccacggcaacgcaagccaaaatacaaaccaatcaacaacgggatagcttagaaacagcagtgcaaatgggaacattaggcatgggaggtatgtggtaatggcaagtaagattacaggtaaaggtagctttcgtggtgtgccttttcttattgaagaagagcaaggcttagacggaggtcgccgtattgtctcacacgaatatccgttgcgtgatgagggtttaaccgaagatatgggcaaacgcctgcgccgttatcaagtctcttgcttagttatcggtgacgatcacttagcacaggcagaaaaactgattgacgcccttgaagccagtggtgcaggcacgctcaagcacccttactttggcactattgaggtgcgggtggacgactaccgtgcgaaaaactcaaccaaccatcaaagggttacgcgttttgacatcaattttctgccggcaatcgaaaaaaatgccccagaaattgccgaagacaccgcttattcggtgttgtcggaatatcaagcaaccctcaatagcctgtcggacgaatttgccgaaatggtgcaagatgtgtcgggttttatcgaatctatggtagataatccactgtttcgccttgctgatactaccgccgcatttatcgaaaacatctttgagggcgtggcaaatacggtgagcggattaacagaagtgaaagacaaagccttgtcgattaaaaaccgcttgagcaatctgcttttaacgccaaaagtgttggcatacgaactgcaacaactgacaagactgaacgtgcgaagtgcggtcaattcgcaacgacaatttgtacaacacattgtgatcactgattccatcagctcagcattaggcgatttaactgcgactaaaaacgaaatcagcaaaagcacactggacgaaatggtgacagccaaaaccaacaatgtggctgaaacagaaattttagcccgtcagtttaaaaacttacacgagcaagaaatttttgatgccttgatgaacaaaaccacgtttttattaaaacgtttagtactttctacccttgcggtggaatatggcaaagcgatttctgatgcggtgactgagtctgtggcacagaaaacggtcacggaagagacaatcgccactctgattgaatccaaaaccgatgtgcagcgttacattgctgaggtggacgaacagctggaagcggtcattttagacaacgccgatgcagaacagtggacaagctacgcagcccttgagcagtatcgcttaaccttaatgcgagatttacaaatccgtggcgagcgattggcaaatgccattgaagtgaagttaaacgacacttaccctgccattttgctcgaataccgccacaccggaaacagtaaaacgtggaaacgcttggcgctgcgtaacggtatttcgcacccgctcttttgtttaggtggcactaccttggaggttttacagtaatgccagatacaaataacacagaaaccaataataagatcgaactctatctaaatggcaaaattttatccggttggaaaagccttaacctgcaacgctcgctggaatcaatgagtggtcgttttgatttaggcattgctgtgcgacctgaagatgatatatcagtgcttgccgcaggttcgccactggtgctgaaaatgggcgggcaaaccgtgattaccggttacttggatgaaatcaaacaacgcgtaagcggtaacgacaaaactatctctgtgagtggacgagataaaacttgcgacttggtggattgtgccattatccacaacagctaccaattcaaaaaccaaactgccaaacaaattgccgaagccatctgtaaaccttttggcattagcgtagtatggcaagtgcaagcccctgaagccaatgaacgaatccctgtctggcaagtagaaccaggcgaaaccgcctttgataatttaagcaaaatcgcccgacacaaaggcgtgttagtcaccagcgacgtggacggcaatttgcttttcaccgagccgagcaacaagcaagtcggtaatcttacccttggcgaaaacttgctcgaactggaacaaaccgacagctggttgcaacgcttttcgctctatcgcgtgattggtgacgcagaacaaggcggcgccaaaggtgataccaaaaccaaaaacaaagcggcaaaaggcaagaaaaagatgatggcgtggtagaagatcccgatatttacccaggaccagcagaaggaggcaagtaatgagtgcaagcggtttaaaagtagaagtcaatgacgaagccatcaatcgttatcgcccgatgattattattgccgatgacaatatgaccggctctagcggttatcaacgtgccgactgggaacgcaaacgtcgccaagccgaaggcaaaaagccacagcacgagtgcaaggttggtttaagcctgacggcacactgtggctaccgaatgaactggtagtactcgatgccccacaatttggcatacacaaggctgaacgcctgattgtagattgcacttacaccttagatgagaaaggtaccattactgaaatgaccttaatgcaccgtgatgcctttgatgaaccagctgatgacaccttagacgataccaaagacagcaaaggcaagaaagacaaaggtaaaaaaggtaaatcgaaaaaggcgaagaagtctgataaagacaacgtgtctgaatttactggttttttagactaatttaaacgagatttaaacaggatttaaaagaggtttatgcaagcaataaatcgcataattgccccacttaaacgagggctacaactactggtcagccgtgcggtggtgtcagtggtgaatgatgcctacgcacgccaaaatctccagctacggctgcaatcagaagaagtggccgatgatgtggaacgcttccaaaactacgggcattattctgtgcccaaagccggtgaagccattgtggtgtctgtcggcggcaaacgttcccacttggttgccgtggtggttgatgataaaagcgtgcgtcctgccggcttgattgctggcgacagcgtgttgtatcatttagaaggtcatcaactgcgcttaaccgaaaatggtgaagcgatcctctcgtgtaaaaaattcactatcgaaaccgacaccctcgactgttccgcacaacaaatcacgtttgatagtccgcaaacgacctttaccggtaacgttgatattatgggaatatcaacagcaaccgaccaccagtcaagcggaatcagcggaaaaaaccacgaccacgaagaacgtgtgggcaaacctgttccgtaaggagcagtatgtcagatttagccctaacatggcataacggcgaaggcgacttggtgctaggcactgagtcgcttttgcttgatgatagccttaccaatgccattatcattagcctgttcactgatttgcgcgtggagggtgaacgtggctggtggggtgatagctataacgatggctttcaaaccggctcaaaactttggactttaagccgtgccaaacaactccccgaaatccttgatgacgcgcaactttacgccagccaagccttgcaatggctagttgatgatggcgtagccaaaagcgtgcaagtgattgcctccaatccgcaaatgtcggtcttgctgttagaaatccttgtggtgttgcccgatggcagcacagaacaacgcacctttcgtgcaaattggagtctctaatggcatttaataccccgacactctctaccctgattaaacaaggcgagcaacagtttcaatatcgcttcccaacacttaaacgacacaatgtgattggcgtgattaaccgcatttgtgcagcattaagtgccggcgaacatatgcacttggactggctcgcacgccaaattatccccaccaccgcggaagaagactatttaatcgaatactgcctctataaaggcattgtacgcaaacaagcctcaaccgccacgggattagtgactgtgaccgcagccaacgacactacaatccccgcaggcacagtgtttgaagataccaacacagggctgacctttatcaccacccaagaaaccgtggtaaaagccggcaccgctgatattgcggtgaaatgtgaaaccacaggcgtagaaggtaatttaaaagccggtacaagcctttcactgacctcggcaattttgggcttattgcccaccgcaaccgtcaaagtaatgagcggtggcgcggacattgaatccctttcgcgtttattagcacgcctaatttatcgggttcagtacccgccagctggtggagcatcacatgattatatacgttgggcaacggaggtgcctggtgttactagagcttggtgtttcgaacgctattatggtggtggcacagttggcgtagcatttgcttgtgatgaacgtgaagatattttaccaacgccagaagatattgcccgtgtgcgtgcctatatcgaaggacataagaatgaagtaacaggacaatttgaaggcatgccagcaaatgtagaactgtatgtcttcgcaccacagtttcaagcggtcaattttaagatccgtcttgcacctaatacgccaaccttacgccaagcagtacgtaaaagccttgctgcttatcttgccaacgctggcgtgggggcgttgctctatctttcgcaaattcgtgcgaccgtttccaacaccgcaggcgaagtcgataacagcgtgatttttccaaccgcagatgtgcaattgttaagcgataacatcgctatcctaggagacatcgaatggctatgacccacgccagtatttagacgcggcgataaaattgctcccagtagggttagcgtggaaacgagcgttagacagcaatcttgccaaggtgcttgccgtgcgttgtgaccaacttgtagaagtcaatagcaaagctcacaccctcatcaaagagcgaatgccggggcaagctacattgttacttgaagaatgggaaggattttacggcttgcccgagtgtgggcggcaaattgtagggaaaacgctagtacaacgacaaaagcaagtacaggaaaaagagaatgaagtggggtcaaatagcaaacggttcttagaagagatagcaacccaagctggatttaaagtcagagttgttaaccattatccacaccattgcttgcgagattgtacctacccactttatgaacaagcaaaccattggcgcatttttatgtacaccccagcagtatcatctattaggtacgcaacttgtttagatgatgtggtgaaaaatttaaccatatttgagcgtaataaagagctagagtgcttgttaaaacgttatcaatacgctcatttagaatttgtatttatctatgaagaggaaactcaataatgtatcacttagacaatgattcaggggtgtcaacgtttgccttggcccccgttaaaagcacacagcgtctttggtttaccgaaggtggtcatggcaatgctatcagttatcctggtgctgactggtttaatatggtacaggccgaattgttctctattttagatgatgccggaatccagcctgataaggggcggttgaatcagatttcacttgctatccgtaaattatcagaaggtaaagttgaagattttagccaacaactcaaacaagccgatggttataaatatatcggtcggtgtaagtctgttgctgagttgcgcactatccgcccaactgaaaatgggcaacgcattttggtagatgcttattatgaaggcagtactgcaggtggtggagagtttgttgcggatttacaagacctaattacacctgatgacggtgggacatgttttgtagtaccgaataatggtgggcgctggaagcgattgttctcttcatcattgcaagataccgatttcggcgtaattggcggcgttgctgacgatacaacgaatttaaatgcgtttttagatgcgttgcggacatataaagttaaaggctactttacttcacgccactataaaacctcagctgcattaaatattgcgggggtcgatattgaaggggttctagctggttataaaaacaaacacggcacgcgaattacaggtaacggtaaccacaatatctttgagcaaatggggggggaattacaacacattacttactcgcttaaaaattttgcgttaagcggtggcattgttgggttgaaaatgacctatgccgtcaatgcagtggttgaaaatgtatttattgacaatgtagaacgtgctttcttgctgggtgactcacaattcgtcggcccgatttggtgcagcctgaaaaattgccgtggtgaaggtcgcatctctggcttggagattgatggcaacaaatgggcaaacgctaatatgtttgaaacttgctttttcaaaggcgacgaatttgccggcagtattacggcaaaaggcgggattggagcagtctcgaaccattttgttaacaccgaatttgctggtaaaggtgttggtgtcaagctcgggaaaaacaagtcgaccgcttttgacaactgctattttgagagcgaggggccatccctactcatcgaagattcaaccgcagatttagcattgaacaatgcaacatttggaagtttaactgaaaataataagacggggaaaacatcgtttatccatcactctttaggcacttgtaatatgtctatttcgagtgggtatatttatctcgctggcaacaatcaaaacaacttagcatttattgagagtgataagccggaatctcttgtggtaaatatggcgacaccagtaaaacgagaaatatatacggcaactggctttaaattattcaaaaatcctgatttaccaaacaaaaattcccgggtgcactatactagtgggtatgtttgtgagttttctagccagaacaaaaatgcagagcttggtaatggtgatttaacagcttattacaatttaaataacagtcgttgtgctgttggattaaatttaaaaattggttcaagcacaacaaaaggtacagggcaatggcaatttcgtttaccattccaagctagtggaattggcaaatactacttgggtcaagcaatagccataaaagctgatggtagtaagttaatgacaggtgtagcacgtattgtaggagggtcaaaccaagttgtagcttattttaataatgttaatccagctgatgctacacggccgttcgaatggactgaaggtgaccgattagatatttcgattgagtatgagatttaaaaatgccaaagaaacactactgtacaggttggcgaaaagcccctaccaatatcaatagttgttgccaccaacacgaccgagactacggcatacacggcacaatcagtcgcgctgatgcggataaacgtctaagagaatgcttaattgcacaaaggtatccattcaaggcatggatattttgggtgatagtacgattattaggttggatattttataaggaaaataaactaagccattaaaacaacgaaaaaatatcagggttttatattctcagtttttgaaacgtaatattgaacgaattagcaaatttgataaaaggagggtttacctcgcacaaagtttaaaaagaaaagacggcgataataacggcacggcaatgcgcgttattaccagctacgcagaacatgcctgcatatagccatacgccgcctaccttgcgcaaggcgggcggattgtaacaaatcttttaattatggagaatatatgcagtcaattaaaacaatccgttgcacattttgtaacaaattattggcgaaagtaggtacagttggttatttagaaatcaaatgcccacgctgcaaagtaattaactttactaaataactttatttgagtgtcggaataccttgagtatcagaacgccatagaaggaaaaactatggcaaacaaaaaaacttttaaacaagccccgctaccgtttatcgggcaaaaaagaatgtttttgaaacacgtggaaattgtgttaaacaaacacattgatggagaaggtgaaggttggacgattgtggacgtatttggtgggagtggtttattaagccatactgccaaacaactaaagccaaaagcaaccgtaatttataacgattttgatggctacgccgagcgattaaatcacattgacgacatcaaccgattacgccaaattatcttcaattgcttacatggtattataccaaaaaatggacgattaagcaaagaaattaaagaggaaatcatcaataaaatcaatgatttcaagggttataaagacctgaactgtttagcttcttggttattattttctggtcagcaagttggaagtgttgaggcgttatttgctaaagatttttggaattgtgtgcgccaaagcgattacccaacggctgagggctatttagatggcattgaggttataagtgagtcgttccataagctaatcccccgctatcaaaatcaagataaggtgctactattacttgatccaccttatttatgcactcgccaagagagttacaaacaagccacttactttgatttgattgattttctacgcttaatcaatctaaccaaacctccttatatcttcttcagcagcacgaaaagcgaattcatccgctatttgaactatatgcaggagagcaaaacagataactggcgagcgtttgagaactataaacgaattgtggtgaaagcgtcagcttccaaagatggaatttatgaggataatatgatttataaattctaaatttaaacgctctctaaataccgtttaaacatataaatgagccattaaaacaacgaaaaaatctcaaggttttattttcgtagttttaatggttttttttcgcagttttaatggctcgctacaacgcaataaaatcgaactcgcaatataagtctgagcaataatgatccctacaggggaaaaaatccatttacttataaaaggaagtagttcagccaatatcccttgtgaactaaaaagtagaagcaaacttagtcctgtgactaatggtggcaaaaccattggtaaatcaaacaaagtgtcaaaaaatgattgaaaaggcaaccgcacttgactcattcgccatgcagatggaatagcaatacataatgctaatatcaaagaaaaaagagacgttcccaatgacattagcaatgcaaaatgcaattcggaattaaataatatttgttgaaaaaaataaaaatctaattttgcgattaaagaaagcaccgatcccataacaacaaataatagtattaataatgggatcagcgctaactttaaacttagacaattatttagccggtaagaaaccttcatcagtaaaatacttcacgccttgaggagatttaaagaaatcaaataactgttgagcttcttttggatatttagaagaaaaaagtagaccaatagtaactttttcttctggtgtgccttttggacttggtaataattcaaccttgtctcgaactttccaagcacctgaacgacctactacagctgcatctacatcaccatttaataaatatagcattaattgttttaccgtcgcagctttcacaacaattttatcattaagttgcttttgatatcctgacaactcaaacattttttcagcgcctttaccaagagccattgctttactatcaccaatacctaaacgtaatgagctttcagctaatgctttaaaagaatcaatccctgaaattttatctttacgaatagccataactggaacatgcaatactatggtccctatattgtttacatcattagttttctgtaattttgtgacataatcctctgaacccgctaaaaaaagatcaccactttttaccgtgttataacgagctagaatctgtccagaaccaccatattcaacagttactttatttcctgtttcttgttcatattggtgaataattttttccacaggctccttcagtcccgccccagcatataaatacaagtctgcagcttgtacagaaaatgtagttaaaatcattgaagttacagcaactaattttttcattttctctccttataaaatgagtttcagcgaaaatcgatatatataaaattgtataatgaattattcgaaagatttattcaatctttagtttataaattaatcgattttttttctaatttcatgacatggcactaattgacttaattttgaaacaacaaaaaaggttgggactccccaacctttcacttaatctttcaataatttaattttttcaatcacatttgttgttgaacaaccattttcaaagtttagcactttaacatcgccaccgtttgcccaaacttctttactgcctgcaatctcttcgggtttgtaatcgccgcctttgactaaaagatctggtagaatttcgccgattaaacgttgtggtgtatcttcagtgaaaggcaccaaccagtctacggatgccaaaccagccaataccgccatacggttttcaagattattaattgggcgactttcaccttttaagcgtttaacagaatcgtcgctgtttaccgcaacaattagacgatcgcccaatttgcgtgcattttctaaataagaaatatgccctggatgcaaaatatcaaaacagccattagtcatcacaattttttcaccgcgcgctttagcttgtgcgacagcatcttttaattctgcttcactcataatgccaaatccagtttcaggacgagcatgaatcgcattttcaagttccacggtcgaaaccgttgaagtccccaatttccccaccacaattcctgcggcaacattggctaggtaacaagattcttcgaaagaacgtccatctgctaatgcggttgctaatacgctaatgacagtgtcaccggctcccgtcacatcaaacacttcttttgcaacagttggcaaatgataaggctcttgatttgggcgtaataatgtcatgcctttttcagaacgcgtcaccaaaagtgcggttaattcaatatcagaaattaattttaaacctttctcaataatctcttcttccgtattgcatttacccacaacagcttcaaattcagacatattgggtgtcaataatgtagccccacgataacgttcaaaatcagttccctttggatcgatcaacacaggcacattcgctttgcgtgcaatttgaatcattttctgaacatctttaagcgtgcctttgccgtaatcagaaagaatcaaagcaccgtaatttttcaccgcactttctaacttcgctaataaatccttgcaatctacattattgaaatcttcttcaaaatcaaggcggagcagctgttgatgacgagataaaatacgtaatttagtaatggttggatgggtttctaatgcaacaaaattacaatcaattttttgtttttctaataagagggaaagtgcagaaccagtttcatcttgtccaatcaatcccattaactgaacgggtacattgagtgaagcaatattcatcgccacatttgctgcaccacccgcgcgttcttcattttcttgtacacgaaccactggtactggtgcttctggtgaaatacggttggttgcgccgaaccaataacgatcaagcatcacgtcgcctaatacgagtacttttgcttgcttaaattctgctgaatattgagccattttaaaatctctctatttgaataaccaaaattgtggcgattttaccacaactcaaatttacgataaactacgcccctaacttacgtggaaagaacaatgaaaaacgaaaaactccctcaatttcaaccgcactttttagccccaaaatactggcttttttggctaggcgtggcaatttggcgaagtattttatgtcttccctatcctattttgcgccatattggtcatggtttcggttggctgttttcacatttaaaagtgggtgaacgtcgagctgccattgcacgccgtaatcttgaactttgtttcccagacatgccagagaatgaacgtgaggtaattttgcaagaaaatctccgttcagtaggcatggcaattatcgaaactggcatggcttggttttggtcggattcacgtatcaaaaaatggtcgaaagttgaaggcttacattatctaaaagaaaatcaaaaagatggaattgttctcgtcggtgttcatttcttaacgctagaacttggcgctcgaatcattggtttgcatcatcctggcattggtgtttatcgtccaaatgataatcctttgcttgattggctacaaacgcaaggtcgtttacgctctaataaagatatgcttgatcgtaaagatttacgcggaatgatcaaagctttacgccacgaagaaaccatttggtatgcgcctgatcacgattacggcagaaaaaatgccgtttttgttcctttttttgcagtacctgacacttgcactactactggtagttattatttattgaaatcctcgcaaaacagcaaagtgattccatttgcgccattacgcaataaagatggttcaggctataccgtgagtatttcagcgcctgttgattttacggatttacaagatgaaacggcgattgctgcgcgaatgaatcaaatcgttgaaaaggaaatcatgaaggacataacgatatatatgtggctacatcgccgttttaaaacacgtccagatgaaaagacgcctagtttatacgattaaaagtgcggtcgaatatcaccgcactttttgatagaattttctcaaatttaaaaaattaacgaataacctcaccatgacaaccaattattcagctcaagaaattaccgttcttaaagatctcgaaccagtgcaaattcgcccgggaatgtacactgacactactcgccctaatcatttagcacaagaagttattgataacagtgtggatgaagcccttgccggttttgccacaaaaattgaagtaattttacaccctgatcaatccattgaagtcacagacaatggtcgcggtatgcctgtggatattcatcctacggaaggcgtttctggcgtagaagtgatcctgactaaactgcatgctggtggtaaattctccaataaaaattatgaatttgcgggaggtttacacggtgtggggatttctgtggtaaatgcgctttctgaacgcgtggatattcaagtcaaacgcaatggcgaaatctataaaattgcctttgaaaacggcagtaaagtagaagaattggaaattatcgggacttgtggtagacgcacaactggaacaatcgttcacttcaaaccaaatccaaaatattttgacagcgcaaaattttccgttagccgcctacgccatttattaagagcgaaagcagtcctctgttcagggcttgaaatcaaattcattgataaagtaaacaatactcaagacatttggttatatgaagatgggctttccgattaccttatcgaagcagtaaatggctttgaaacccttccgaaaaaaccatttgttggcgaatttaaaggagcaaatgaagcggttagctgggcattactttggttgccagaaggtggcgaactaatcggcgaaagctacgtaaacttaattccgactattcaaggcggaacgcatgttaatggcctacgccaaggtttattagatgctattcgtgaattttgcgaatttagaaatctattaccacgtggggtaaaacttaccgccgatgatatttgggatcgctgttcttacattctttcccttaaaatgcaggatgcgcaattcgcagggcaaacaaaggaacgcttatcatcacgccaaagtgcggtgtttgtcagcggtgttttaaaagatgcgttcagcctatggctaaatcaaaatgtacaagatgctgaaaaattggcagaaattgctattagttctgcacaacgccgattacgtgcagcaaaaaaagtcgtgcgaaaaaaactcgttagtggccctgcattaccaggaaaattagctgattgtggctcacaggatttagaaaaaacggaattatttttagtggagggcgactctgcgggcggttcagcaaaacaagcgcgtgatcgcgaatatcaagcgattttgccgttacgtgggaaaatcttaaacacatgggaagtttcccctgatcaagtattaggttcaaccgaaattcacgatatcgccgtggctctagggatcgatcctgacagcaatgatttatcacaacttcgctatggtaaagtctgtattctcgcggatgctgactccgatggtctgcatattgccaccctactctgtgccctgttcttacgtcattttccgaaattggtacaagacggtcacgtttacgtagcaatgccaccactttatcgcattgacttaaataaagaagtcttctacgcattagatgaaaatgaaaaagaggcgattttagatcggttgaaaaacaaaaaaggcaaaccgaatgttcaacgctttaaaggtttaggtgaaatgaacccatcgcaattgcgtgaaacaacaatggatcctaatacgcgccgtctcgttcaattaacttatgatttaggggaagatcaaggctcagatacattagaactgatggatatgttattagcgaaaaaacgttccgaagaccgtaaaaattggttacaagcgaaaggcgatcaggttgatttatctgtttagactaaattaatctcagcaaatccgaattttaataaattaagaatatatcaattaacagaaacaaaaatgacaaatatcaactatgaaggcattgagcaaatgcctctacgcaccttcactgaaaaggcttatctcaactattctatgtatgtcatcatggatcgtgcgttgccttttatcggtgatggtttaaaacccgttcaacgtcgtattgtatatgcgatgtctgaacttggcttaaatgccacggcaaaatacaaaaaatctgctcgtaccgtcggtgatgtactcggtaaattccatccacatggtgacagtgcttgttatgaagctatggtgttaatggcacaacccttctcttatcgttatccacttgtagatggtcaaggtaactggggggcaccagatgatccaaaatccttcgcagccatgcgttatacggaatctcgcctatctaaaatctctgaaatcttgttgaatgaactcggacaaggaacagtagattatcaaccaaactttgatggaaccttggctgaaccacaatatttacctgctcgtttaccgcatattttattgaacggcacaacaggtattgcggtggggatggccacagatattccaccacacaatattaacgaaattgctgatgcggcagtaatgttgctagataatcctaaagcgggattagatgatgtacttgaaattgttcaaggcccagattttccaacagaagcggaaattatttcgccaaaatcagaaattcgtaaaatttatgagcaaggtcgtggctcaataaaaatgcgtgcaacttggaaaaaagaagacggtgaaattattatttcagcgcttccacatcaatcttcgccatccaaagtcattgcacaaatagccgaacaaatgacggcaaaaaaactgccaatgctagaagatattcgagatgaagccgatcacgaaaatccaattcgcattgtgctagttcctcgctcaaatcgcgtcgatactgatgccttaatggcacatttatttgcgaccacagatcttgaaaaaagctaccgtgtaaatatgaatatgatcgggcttgatcataaaccagcggtaaaaggcttattagaaatcttaaatgaatggcttgacttccgtcgcacaacggtcactcgtcgccttcaatatcgcctagataaagtgctctctcgcttgcatattttagaaggcttgatgatagcctttttaaatattgatgaagttatcgaaattatacgccacgaagatgatccaaaagcagagcttatggcacgctttaatttaagcgatgaacaagccgatgccattttaaatttacgcttacgtcatttagcgaaattagaagaaaaccaactcaaagcagaacaagatgaacttgaaaaagagcggttaaatttagaagcaattttaggatcagaacgccgtttgaatacgcttatcaaaaaagaaattcaagaagatgcgaaaaaatatgccaatccacgtatgtctcaactggtcgaacgtgaagaagccaaaatgatctctgaaagtgatatgacaccagcagaaccagttactgtcatcttatcagaaatgggctgggtacgttgtgcaaaaggacacgatattgatcctaaatcattaagctacaaagctggtgatagctatctagctcacgcttgtggcaaaagtaatcaagccgttgtattcattgatagcacggggcggagttatgcactcgatccgctttccttgccttccgctcgctcccaaggcgaaccacttacaggtaaactcaatttacccactggtgcgaccattgaatatgttgtaatggccagcgaacagcaagaattattgatggcttctgatgcaggatatggttttatttgtaaatttgaagatttaattgcacgtaacaaggctggaaaagccttgatttctttaccagaaaatgccaaagtgttgaagcctaaaacattgataaattctaccgcacttgttgtcgcaatcacatcagcaggcagaatgttgatttttccagcacaggatttaccggtattatcaaaaggtaaaggcaataaaatgatcactattcccgcagcgaatgcaaaagatcgtagcgaactattgacaaaattattgcttatttcagatcaagcaagtcttgaattttattctggaaaacgaaaaattgtattaaaaccagaagatctgcaaaagttccgcgcagaacgaggcagaaaaggttcgacattaccacgtggattacataccaatcttgaaattatggtaatcgagccgtaacacaacacatcacttaaacataacatagggagatccaatttatgagctatacttttagcacgtatgaaacccttgcattagcaagcttagttttgctattgggctattttttggttaaacgcattaatgtattaaaaacatttaacattccagagccagttgttggtggctttattgttgccattggtcttttaatttggcacaaaattgatggaacatcctttaacttcgataaaaatctacaaaccacaatgatgttagtgttttttacttctatcggtttaagtgccaacttttcccgtctaattaaaggtggaaagccactcgttgtatttctattcattgctgcattattaatcttcggacaaaacgttattggcattgcaagttcaatggcattaggaatccatcccgcttatggcttacttgcaggttcagtaaccttaacaggtggtcacggcactggagctgcttgggcggatacatttgcacatcaatttaatctacaaggtgcaactgaaattgccattgcctgtgcaactttcggtttagtattcggtggtatcatcggtggtcctgtcgctcgtttcttattaaatcgccaaaaacaaggcgaaaatcctgaaaatgatgaagttgatgacattcaagaagcatttgaacacccaacttataaacgtaaaattactgcacgttcattaattgaaacaattgcaatgatttcagtatgtttattaattggtcaatatttagatgtacaaacaaaaggtactgcactccaattaccaactttcgtatggtgtttattcactggtgttattgtccgcaatattttaaccaacattttccgtttccaagtagcagaatccgctattgacgtattaggtagcgtaggcttatccatctttttagcaattgctttaatgtcattaagactttgggaacttgcaggtttagcaattgacgtattaattgttcttgctattcaagtagcatttatggctgcctttgcaattttcattacttatcgagcaatgggtaaagattacgatgccgtcgtattaagtgctggacactgtggttttggtttaggcgcaaccccaacagcaatcgcaaatatgcaagctgtcaccagccgttttgggccatcgcacaaagcatttttaatcgttccaatggtcggtgcattctttatcgacttaatcaacgctgcgctattaaaagtttcatttgcagttgtaaatatactcgcgtaaagtgcggttgaaattgacaatgttttagagaaatgcctttatcttgaattgataaaggcatttatttcaatataatcaattatttcagctgcaatatcaatcccacttgttttttcaatcatttctaagcctgggcttgcattcacttctaaaaccaataatcctttttttgaacgaattaaatccacgccagctacatctaaaccgatagcttttgttgcttgaatggctatctgcttttcttcatcgcttagggtaattttttcggtttttccgccacgatggcaattcgcccgaaactcaccattttgcccaattctctgcatcgttgctaccacttgatcacctatcacaaaacaacgaatatccgcattgcccgcttcttcgataaaatcttgctgtagcatagatatattggtttgcttaaaagcttccataatactcaccgcactttgtggcttttcagctaaaattaccccaattccttgtgaaccatttagcgtttttaaaattgtcggcgaactgatatgaggtatcgtcgcctgagcttgtacttcaccaccacttaaaagtgaattgggaacaggaataccagccttcagcaaaagttgcaaacttttccatttatcacgcgcatttaaaaatgcctgagatgaatttaaacaaaaagtccctttgccttcaaaatgctgtaagactgaacatcccatttgcgtactcgttgtgccaaatcgaggcaaaactgcatcataatcagacaataaataaggtttcgactctgaattttcttgataaaaaatctgaaagtgcggtggattttgcgagagttttaagaaacagtgattcggatctaaaatatccatctcatgcccttgatgtttagccgcttcttttaagcgttggcaactataaagacgaggttctcggcaaagcattaataatttcataacatttaatttattatctacgatgttccgtatattacacgaataaaaacgctttatgtagatgataaaaatcagtagaattacctagaatttttaactcaaaaaagggaaatcttatgttcgttgttatttttggtcgtcctggctgcccttactgtgtacgagcaaaaaaccttgctgaaaaattaaaaggcgaagttgctgattttgactatcgttatgtggatattcacgcagaaggcattactaaagaagatttatcaaaatctgttggtaaaccagtagaaaccgtaccacaaatctttattgatgaaaaaccaattggtggttgcactgattttgaagcattaatgaaagaacaatttggtatcgttgcttaatttttctttttaatttatacaaaaaagccactttcaatcgaaagtggcttttttcatagaagagttttaaccgttataacgtttaaaaattaatgtcgcatttgtaccaccaaaaccaaagctgtttgacatgacagtttgtaatcctgcattttctttcgtctcagtaacgatgttgcaaccttcagcggcttcatctaaggtttcgatattaatacttggtgcaataaaatcattatccaacattaataacgtgtaaattgcttcgtgtgcacccgccgcacctaaagagtgaccagtcattgatttagttgaagaaatcgctgggattttgtcaccaaatacatttttgattgcacctaattctttcacgtcacctactggtgtagatgtgccatgtacattaatgtaatcaattggggtatcgacagttgccattgcttgtttcatacaacgctctgcaccttcaccacttggtgcaaccatatcgtaaccatcagaagttgcgccataacctacaatttcagcgtaaatttttgcaccacgagcaagtgcatgttctaattcttccacaaccacaacagcaccaccacctgcaataacgaaaccgtcacgatttgcgtcataagcacgagatgctttttctggcgtttcattgtatttagttgaaacggcacccatcgcatcaaattcagttgcacattcccaagataattcttccgcaccacctgcaaaaaccacatcttgtttgcctaattgaattaactcaaccgcatgaccgatacaatgtgcagaggttgcacaagcagaactcattgaatagttcacaccacggattttataaggagtagctaaacaggcagaaacacttgatgccattgttttcgttactgcgtaaggaccaatcgcctttacacctctaggaccacgcaccgcatcacaagccactaactggttatgtgcagaacccgtacccgcaccaatcactaaaccagtacgatcattagaaacttgatcttctgttaagccagcatcctcaatcgcttcacgcatagaaagataagcataagccgctgcatcacccataaaacggaacactttacgatcaatgtgctcgcttgggtttaatttgattgttccggcaacatggctacgcatattcatttctacaaactcaggcacaacttcaatacctgatttccctgcttttaatgaagccaatacttcttctttgttgttaccgatacttgaaataatcccaaagcctgtaattacagttcttctcattgcttcttccttattgttttatatgtaaaaataacgactcaaaattactacgaaataaaaatatttcaagcaataattcatttgttcgaccagttcagaaaatcgcgttattatacgcaaatttcattaggcaagaaaggaataaaaaatgacctttagcgtccaacatgctgagattcacttcaaccaaaaccatattcccgtctcagatcaattcgatgatgtctatttttctaacgaaaatggattggcagaaaccgattatgtttttctacaaggtaatcaactttgggaacgttggataacacacaaagacgctaattttgtcatcgctgaaacaggatttggtacaggattaaatttctttgcggtaaccaaattgttccgtgaatttcgccagcaacacgagaatcatcctttaaaacgcctaaattttatttcctttgaaaaatatccgctaaaaatcaccgcacttttgcaagcgcatcttgcctgtccgcagtttgaagatttaagcgctcatttgcaacgttattggccttcattgattctaggttgtcatcgtattcattttggagagacaaccttagatttatggtttggtgatgtatcagaaaacttgccacaacttggcgattatatgaatgaacgtattaatgcttggtttttagatggctttgcgccgagttaaaaatcctgaaatgtggaatgatgatctctataacttaatgtttcgtttcacgaaacccaatggaacttttgccactttcaccgcagcaagtgcagtcagaaaaggacttgaatccgcaggctttaacgtgacaaaacgtaaaggcttcggcaaaaagcgagaatgtttaagtgggctaaaaatacaatcaaaatctaccgcactttcaacaccttggtatcttgctcagcctgcgaaaatggaaaaacaagatgtcgctattatcggcggtggtattgcctctctttgtgctgctatttccttaataaaacgtggggcaaaagtcaccatttattgtgaagatgacgcgctcgcacttaatgcttcgggcaataaacaaggcgcattttatccgcaacttagcgatgataatgcgcttaccgttgatttttacctgcacgctttcagttacggtcgccaattacttgattgggcaatcgaacaaaacatagtgtttgaacacgaattttgtggcgtggcactatgtgcttacaacgaaaaaagtgcggttaaattaacaaagatttctcagcttggtttaccgaacgaaatcttccaaatgctgagtgctgaacaactcagtgaaaaagtgggattaccgcttaattgcgaaggcggttggattgaacaaggggcttggcttgcaccaagacaatttgttcaaaatgccttttcatttcttgaaaagcagggtgtcgtcattaaaaccgcacaaaaaattaccgcactttctcagctagaaaaaggttgggaactaaaaaatatgcaaggtcaaaaatactgccatgaagtcgtcattcttgcgaacggacataaaattactgattttgttcaaacagaaaagctaccgctctaccctatccgcgggcaagtcagccaaattccaacatcagaaaacttactcaaactgaaatctgtgctttgttatgatggctatcttactccagccaatcaattaaaaacctcacattgcatcggcgcaagcatgttcgtgataatgttgatcgcgattttagcgaacaagaacaacaagaaaatcaacaaaaactccagcaaaatatcgcccaaccttggacgcaagatgtggatacatcagataatctcgctcgtgtaggcattcgttgctctgtaagagatcttgccccaatggtgggaaacgtgcctcattttgaacagcaacaagcggattattacaatctatttaacctccgccgccgtaaacaacctattcaaagtgcagccaattttcagaatcttttcttaatcgcagccttaggttctcgtgggcttacctctgctccactcttaggcgaaaccttagcttcaatcatttatggcgagccattaccaataagcgaaggcatattacataatctttcagctaaccgagcttgggtaaaaaagtggttgaaaggttcaaaagttgaataaactcataagattcagagccttacaaaaataactttaacgtgttaaaatcaaacaaaatttaaatataaaaatgaatacaaaaatgctatgcaatcaatcaatcaatcaatcaatcaatcaatcaatcaatcaatcaatcaatcaatcaatcaatcaatcaaattgtaggatttgttaaaacttgctacaagcctgaggaagtatttcattttcttcatcagcattccattcctttttcctccattggaggaatgaccaatcaaaatgttctacttaatatttctggagttaagtttgtattacggatccctaatgccgtaaatttatcacttataaatcgagaatatgaggcattcaataatgcacaggcatatcgtgctggcttgaatgtagaaactcccgtattagatgccaaaagtggcgtaaaactgactcgttatttagaaaatagtaatacgttaagccagatacaattaaacgaacaaagttgtttgtctcaagttgtgaataatttatatcgtttacacaatagtgaatttgtttttcgtaatgtatttagcgtattcgatgagtttcgccaatatttttcattgctagaaaacaaatccgctttttatcaagctgattcgagaatggataaactttcagctgtattttggcaatttgaagaaatcaataaagaggtaattttacgtccgtgccacaatgatttagtccctgaaaatatgttattacaagatgatcggctattttttatcgattgggaatattcgggcttaaatgatccgctatttgatatagctactatcattgaggaagctcatttatcgaaagaagctgctgattttctattagaaacctattgcaatcagacaaataaatatcacaagacagaatttcaaatcgctcacaaacggttaaaaatccatcgtttttgccaaaatgtattgtggtttttatggacaaaagtaaaagaagaacacggcgagaattttggcgattatgcgttaaaacgcttagacgcagcatttaaactgttagaggaattgccataatgcgtggctatctctttggcatactgtccgctgtattttgggcattatctggactgttgtataatgaattgccattaagtgaatatactgcgttagggaaagtgatttcattgctttttttaattgatttttgctcgttattagttatcggcatcacattatggcgaaaaagtgcggtagattttcaaggtgttttttggcaacctgcgttatctggcatattaggcggaccaataggaatgtctgcctatttattaagcattcattatttaacaatctattatgctgcaccgctttcatctctctttcctgttttcgctgcgttaatgtcttattggattctaaaagaaaaaattaccaaaacagcccaattcggattcgccttggctattatttcttcttcgttgcttgctattgaagtaggacaagaaataacctttaatactatcggttttatttttttaataatttgtatattagggtggtcatctgaaatagtgatatcctcctatacaatgcgttctctctctggacttcaggtgtattttttaagactatgtggttcaactattggttatttattgattctatttattctttccttgaaaaatttctcactagatatacttagttttaattatgtacaaattgctggtgtaataatctttggtgcattatcttactgctgctattaccaagcgatttatctgttaaaaccaatcaaagcaatggcattaaatatcacatattctgtatgggcaattggacttggttatctgctctataaacagccaattaagcccattaccttactgctcaccttattattaagtgcaggagtgatcgttacactttattacaaaggggaacaaaaatgaatgcaatcattttagcagcaggattaggcagccgatttaaagacatcacacaaagcacacataaatcattgttagatattcacggcacacctaacttagaacggacactcacttttctacgtcaagcaaatatcgacaatattgtcattgttacagggtatttacacgaacaattcgagtatctaaagaaaaaatatgactgcaccttgatttacaacgaaaaatatcgcgaatataacagcatttattccttttctctggcgcaagacttctttaatgattgttatgttattgatgcggatgtagtgcttaatcgtaatatttttctaacgaaaccatcacacagcaaatatttcacagttattcgttctaaaacgcacaatgaatggctaccgattttaaatagtaatggacaagtaatacgtattgatattggttcactgaatcaacccagtttgtcaggaatatcattctggactacacaggattgcaatatcattctaactttgctcaaagaatacacaagtgaagtgcggttaaaaaatccaaaactttattgggataccattccgatggaatatatagagaaattgaatatctatacggaacaacttaacagtgatgatatatttgaaatggataaccttgatgactatcaccacattttacaaaaattgacaccaaacaaggaaaaataatgaaaaaattgactctcagagaacaacaactcgtttgtctaaacatcttagattatttccacgcactgtgtgaacgatataaaattagctattctctcggtggtggaacattaatcggtgctatacgccacaaaggctttatcccttgggatgatgatattgatgtttatatgcaccgtgatgaatatcaaaggttcgttgatgtttggtttcaagaaactcacgaacactacaatatggaaacggcggaagatatccttgctcaatatactggtgaaatggcaaaaattttcgattgccgcactcaaataacagatgctaagggaagaaaaagcccaatgtttatggatatatttatctatgatggcgtaccgaatgaaccaaagatcatctatccactgatgaaaaagcatcgaagaattaaacttcgcttttcctcttgcaaaaaaagatggttaagggcaaaagaaaacaccgtgcaaaaagctatacttaataaattaagccactttctattttccaaaatgcaaaaaaatttagcacaattccaaataaaatatccgataaaacaatgcgattatattggtcttgtattatctgactacggtggttggcaaaaatcttatatgccgaaggaatattttaaccatgttatttataaagaatttgaaggacgacaatttcaagtaatgaatggatatcacgaacacttaacacaatattatggagattatatgaagcttccaccagaagaagaccaaaagccacatcatattcaagaagcgtatattttgtaagcgaaagggcagatttaattctgccctttttcaattattacttcacttttccacaattcaaacaatacaaatactgacctttaggatcattaaatttagttaatatattcaattctttttgtaatttttgaattggcgcaggcaaaccaagccatttaactaactgctcttgcgccccttttttagtatcgctcaataaggtgctaattaaactaacgttatcatctgtaaaccattccacgctaaaatcttgcacggcagtatcttggcgttgattcactaattgctctgctttattgaccgcttcattaaaagaacctatctcatccactaaaccattttggaatgcatcactgcccaaccaaacctgcccttgagccagtttatctacttgtgttttagaaagctggcgacctttgctgacaatttctaaaaatctgtcataaccgtgctcaatttctgtttgataaatatcttgcacgggttttgctaatggagaaaacgcagatgtattagctaattcagtggttgaaacaccatctgcatgcacgcctattttcttaatactattttcgaaagtcgggaacatcgtgaaaataccgatagaacccgtaattgtatttgaatcggcaataatataatctgcagtggatgaaatccaataaccacctgatgctgccattgcacccatagatacgatgacaggctttccaattttctgtaagttttcagtttcttgtcggataatttcagaagcaaaagcacttccgccaggtgaattaacgcgtagaatcacggctttcacagaattgtcatcgtgggctttacgaagaattcgtgcaatggtgtcgccaccagcattttcttcatcactttctccatcaataatcgttccttcaacattcacaaccgcaattttattcggtacgttgtaatgttctaaacgatcaggcagttgagtcaaataatcatcaaattcgataaggttcgcttttccatcacttcctttgccaaaaagtgcggatagttttttatctaaatccaaacgagttacaacatcagttactaatccacgttgttgtgcgtatgccgtactattgccttttaacgctttaagttctgcaagatactgtttcgcattcggcaaaatgcgatctttcttaatattacgattttcactgacggataaaacataattattccacatttcgcctaaccaacgttgcatatttgcttttgcctcagccgacatatcgttgcgtaaaaatggttcaactgctgatttataagtccctacgcggaaaatatgtggtgtaacggctaatttgtcaagcatctctttaaaatacaaattctcttgcgataaaccgtgaatatccacgcttccaattgaatttaaataaatttcatcagcaaagctcgctaaataatattgtccttgtgaataattatctgcataggcgatcactggtttccctgcatctttaaagtgactgatagcaccaccaataaaatctaatgcgggcaaatctgccccttcaaaataattaagatctaacactaatcctttaattttaggatcatcttccgcttgttgaatggcaaataccacatcaaaagtcgaaatttttctagggacgtgctcgccattcaattcgcttaacgcatcttgccaacgaagtgtttcatctcggttgtccgctaaataaccatctaaattgagcaataatgcgccttcgctcgttaatgcagtagattttttcccgccacttgaaaagctaataatcgccactagcaatagtacaaagcctaaaaacacgacattcatcacaagatcacgaatgaaacacagcactttccaacaaaattttaatacttgaaacatacaaattacctttaaaaaatttgtgctagcgtatcacaaagccttgtcaaaaactatgctataatccaccgcacttttacttataagggataataaaatggatgcacttacacttttaaccacaagaaaatcaaacaaaaaattgaccgcacctgcacctaatgcagaacagcttgagcgtattttcgaagcagcaatgcgtgcaccagatcacggaaaattacatccttatcattttattgtaatggaaaatgagagcttaaataaattagaaacgctacttaaagctgccgttgtagaatttgatcttggggaagaaaaattgatgaaagccgaaaacctagcacatcgcgcacctatggttattggcgtggtagcaaaaatcgatccaactatcgctaaagtgcctggttgggaacaaatgttgagtgcaggttgtgcaacttatggattacaactggctgcacaagcacaaggatttgataatgtgtggatttcagggaaatgggttaatggcactgcattacgagaagcgttcggatgtcgtgaacaagatcgtgtgattgcgttagtcatgattggcacgggcatggagaaagcagaacgtgaatgccgagttatcgatacaaaagattttgtaacctatctataaaatattgcttgctttcctcaatacttagagaaaagcaaaatattgctctactcttcttccaattcatccgccattgtcgccaatatttctcgtgtaagaagggccaatgcacgataaaaaggcaaagttgcttgattttctacttgagttaaaaacttcgctgcacaaggcagtaaaaaagtttcaaagaattcttgttgagccactaaagaatccgaattatcttcaagccaagaggctgtgagcaataataaagcaaaatgatccgcactttccacctctggcatattgcgtacaaggcgaaaattcacaaattcttcaacatcaatgccataagctgaaatagccgtcatcactttaccattggtagcaaataatttttgatactcttcgttcaataaattgagatcgattttaacttgcaagctattcagcgctaattcactttctttatcagtatctaacgcccaaacttggctcaaaccttcttgttgtaaccaaacaaatgcgtcagcgagtactttatctgttggaaaacgataaaaaagattaccgaataatcgactaattaatgaaaaattattaatttgtttttcagacattactctttttcctttaaaagtgcggtcaattttgcttgagttttttgagcagcaagttcaatcatcgctttacgcgccttatcatcaattaaatgaatatctccaaataattcaaactcgacattttcaattccacaataattgaataatccattaatcaaacaatgattaagcgatttatctacaccaaattctttatatttatcaacattactgccaatcgtaataaattgctgcatttgcttatttttgagcaaccccactgattcgccgttttccgttttataagcaaagccatggcttaatacgcgatctaaatagcctttcaaaattgctgggaaccccatccaccaaaggggataaaccaacgtaattaaatctgcttgaagaataaaatcatgctcttgctgaatatcttctggaataataccattgttagcattctgcaattcttcatgagataaaattggattaaaattcatttcataaagatctcgaaaaaatacatttacaccattttcttgactaatttgctcaatacgattggcaatcgctcgcccaaaactacgcactgaattaggatgagcaaaaataattaagtgattcatttttcttacctatttgtagggaaataaaacgtgacagaagtctatcaaaatagagcgcactttgcatataaaatcacataaaaaaagcgggcatatcccgctctcttatttgcatcatcattatgctgcgtttttacgttcttcttccatacatactgccgcagtaaataatacgtcagttgatgagtttaatgctgtttcggttgaatcttgtaagataccaataatgaaaccaacaccgatcatttgtgctgctacatcatcagaaataccaaataagctacatgctaatgggattaataataatgaaccgcccgctacgccagatgcaccacaagcacaaagtgctgcaacaatacttaataaaagcgcactaacgaaagaaacttctaagcctagtgtatgaactgcggctaaagttaagatagtaatagtaatcgccgcacccgccatattaatgttcgcacccaatggaatagaaacagaataagtttcttcatcaagatttaagcgttttgctaattcaatgttcactggaatatttgctgcagaactacgtgtgaagaatgcagttaccccactttcgcgtacacaagtccacactaatgggtaaggattacgacggattttccagtaaaccaaaataggatttacaacaaaagcagtaaataacatcgtaccaattaatacagcaagtaattgcacataaccgcctaatgcgactaaacctttatcagacaaggtttcagccactaaaccgaatacaccaaatggcgcaaaagaaataatcacgtgaacaatttttgatacaccttctgcaaaatcagataatacgttcttagttgcatcagatgcatgacgtaaagccaaacctaaaccaatagaccatgctaatacaccaataaagtttgctttgaaaattgcatttaatggatcatctaccacatttaaaattaatgttagcaacacttgaccaacggcttgtggtgctgaacttgaatcttctttcgcagccaataccacttccgttgggaatgcgaaaccagcaataacagcaacaaatgcagctaagaatgtgcctaaaaggtaaagcacaattatttctttcatattgcttttcgtaccaattttacggtttgcaagggcagccataacaagaaagaaaattaaaattggtgcaacggcacgcagagcttttacaaaaatcgtacctaatacgccaactttttcagcaagattaaaaccaatggtttcttgtaatggtgctgaaatcaatgcaacaacaataccaagaaccaagccagcggcaattcgttttaccaaaccaccctgaaataacagactaaatagacgtgatgtgttcatatttttatctttcttttagtaaatttaacttcagattgttaccaatccacctagggggaattaaagatagcgtaaaattttaatgaaagaaaatatttttattatttttcactctaaaagtgaacttttttctaaagttattagatattctctaaaaacatacttataaaaaaattttttatttaacctattgacaccctgtatgaaatatcagtaaaatttaactgtacaaaaaaacaaggtaaaaggttatttatccatattatttaacaggagataagagaatgaacaaccaaactttggctacacaatatgaaatggatttttcttataatccactgccttttttcagtgatatagaagataaccttaaattcaacaaaaaattagatttaaatctttactgtatcaaacgtccaaaacaaacttgttttattcatataactaacccaaatatgttggcttggggaattgaaagcggcgatatgttagtcgtcgaaaaaaatgacgatctttattctggtgatcttgttgtgctagaagaaaataatgaatttcatgtctatgaatttatggcgcatagcggcaattatcttttcatggcattggattccacaacacaaaatataaatacaaaaagattggtcaaatttacctattatcggcaccgtgaccaatacgattcatcaaatgaaacgtcgcgataaaatgaaatgggcagcgtagttaaaagcaaataaaaaagtgcggtgaaaatcaaccgcacttctatctagtatctagattatatttcaattaattactcgtcgctttacgtctagcaataactgcatcagaaagttgttgcaataatctttcagaatcttcccatccaatgcacgcatccgtaatactttgtccataagtctgtgctttgccatcaactaaatcttgacgaccttccactaaatggctttccaccattacgccaaagatttgtttagaaccaaatgcaatctgattacatacgtcttggcaaacatccatttgctttttatattgtttactgctgtttgcatggctaaaatcaaccataacgtgtggaatacgccctgttttttcaatatcagcacaaactttttctacatcttcagcactatagttagggcctttatctccacctcgtaaaataatatggcaatcttcattcccttttgtagaaacaattgcagaatgaccaaatttagtgacagataagaaatagtgaggagcttccgctgcaccaattgcatctaaagcgactttcacaccaccattagtggcatttttaaacccaacagcacaagataaacctgaagccaactcacgatgaacttgtgattctgttgttctagccccaatcgccccccagctcataaaatctgccaaatactgaggtgtaatcatatctaaaaactcgcccgctgcaggcacaccaagatcattaatatctgaaagtaatttccgtgcaatacgtaacccatcatttaaacgataagtatcattcaaatatggttcattaattaaacctttccaacccaccgttgtacgcggtttctcaaaatacacacgcataataatttcaaggctatctttgtatttttcacgtaatggttttaaacgagtcgcatattcaatggctgctttcggatcatgaatagagcaaggcccaatcacgactaataaacgatcatctttaccatgaataatattatgtgcctcatgacgagtttgcttcactaacgccgcagcctgttcacttgctgggtatttttctaataaggcaatgggtggtaacacctgatcgactttttcaattcgcgtatcgtcgtttgccacgacaatttcaattttctctttagccatacattactctcttgctttcaaatgttgtgtttaaattatgtagctaatctacacttatttttgtactagtaaactagttcgatatgtttttttagaataaaacctacaaattccctattaaactatctttacaactctcttgcaagctgaataaaacgaaataattaagtaaataaaagataaaaaaataccgcacttttgtgctgtactctcgaaattaatggctacttaatacttgtgcaggttgtaatttagcagctcggcttgctggataaaggcttgccattaaactcaatgcaagtgctgcaactaaaaccatcaaaacatccaaccaatgcaactcgcttggcaagaaatccacaaaatacacatcgcccgataataatttcttaccgataacccactcaataccttgaataaaggttgtaagatttaatgcaagtataatgcctaacacaattccaattaagcaacctttcattcctgcctgtaagccataccaaataaaaatacgtttgataaacgcattattcgccccaagcgtgcgcataatggcaatatcgccttgcttatcttttactgccataatcagcgtagaaacaatattaaaacacgcaacaccgatcacaagcaccattgcgatatacattacggttctaataagctgaatatcgcgatacatataaccaaatttactaatccaattttgcatatatagcatctgcggataatcattaagcattgataaatccagatttctcgcagaaaaaggatcatctaatttcaattcaacacctgtaatttgatcaggttgataagtcaaaaaggtttgtgcttgagcaagcggcaataaggcataactataatcaagctgaccatctaagcgtaaaatagaggtaacttgcactggctcacgagttggttgagcaaattgttcatcgccgttttgctgagaaataagcaaggtaatccaatcccctacttttacatcaagttctttagcgatacccgatcccaagaccaatccgccttctttctcaaatttgttccaaccttgctcttgtacaaaattgccaattgaacttaccttatcttctgcttgtttttcaacacctttgacctgaacaactttcaattttgagccattttctaccaatgccgtaaagctaacaaaaggagagattcctttaatttgtggattttgttgtaggcgtttttctaaattttgccaatggtgaatggttggttccgtcgcattgggtgcagataaaatctctgcatggggaaccactgcaagaattcgttgattaagctcacgctcaaaaccattcatcgcacttaaaccaacaattaaaactgcaacacccaatgcaataccaattgcagaaaattttgcaattaacgcgactaaaggatttttttgtttgccacgttgataacgccagctaataaaaaaaggcgtattcattatgcaccttccttcaaaagaccatcttgcatcactaaacggcgtgataatttttccgcaagccccatatcgtgagtgactaataaaaaagcaatattttgctcttgattaagttgttgaatcagctcaaaaatactttcagtggtcttgtgatcgagatttcctgtgggttcatccgctaaaactaacgatggattattcactaaagcacgcgcaatcgccacacgctgacgttccccaccagaaagcgcagaaggacgatgggtaattctatgacttaatcccaccgcacttagcattttttcggcgcgatctttcgcttcagttttattttgatgaccaatcaacatcggcatcatcacattttcaagtgcggtaaaatccgccattaaatgatgaaattggtacacaaatcctaaataacgattacgcaaagcagctaattcattagccgatgctttttgcaaggattgtccattaataaacacttccccactacttggctgatctaagccacccaaagtatgtaataaagtacttttccctgaaccagagcttcccacaatcgcaaccaattctgcaggttccatagaaaaagaaacgccttttaacacttgcgtttgattttcgccttcttgataaaatttattgatattttcgcattttaataaatagttattcattttttactcgttttaaccgcactttagcggcagataacaccatcaaaaacttgcacgagtctatcacacttttccttgagcttaaatttcaatacacctaaagtattcaaatcctgtttcaggaaaatgtttttcaagataacgttttaaatagcgttgggtttcttgactaataataggtcatattctgggtaaccgttatacattacacttaatactgaaatacctcgagtacgacaagcctctaaacttaataatgtgtggtttatactgcctagttttcccgatgtcactaaaattaaagggtaattatttaactggatataatccaacgtcgtcgcctcttcacaataaggtaccattaagccaccagcaccctccaatagtacataatcatatttttctgccaaaagtgcggtagatttttcaatgatttttgcttcaatttttctactttctcgctttgcagctaaatgtggcgaacaaggatattcaaaaacataagggcaggttttgccttgtaaatcttcttccgttaaatcaatcccttgaatctttcgatgtacaagcaaatcatcagcaatatttttacagcctgtttgaatcattttttgtgtaatcacggaacagccttgttccatcaactttttagcataaatgcctgttgcaatcgtttttcccacatcagtatcaatgccagatataaaaataacctttcccataaatattccttactgattttctatgtgagaatagcgtgcgataaaaaataacggatgataagtcaggcgcactttgcccgacggcataccaaacgccgacaagtaatcgccaataaatccattgagattttttcttgtccaatttttttggttcgtggctgttacgcctgtatatttaaggtgtttgagtacatctaacggcgtatcaaagtctagtattaccttaaaatcctcacaccataaaagctcaaaatctttggctaaccaagtctgccattgggataaagtcgggtaatttaagcctatatttgtgatctggcggacttcttttaaattgtcttcgccaaaggttgcaaccgccaataatccgtttgttttcaagcctgttttgcaatgggcgataaaagcgtcgggttggtgaaaccattgcacggcggatgcgcttgcgattaagtcaaattgttgcaaaaaaaggaaatgttcggcatcgccgcaataaaaatcaaaggattgcggcaatttttcagccagttgggtctgcacatcgcacaaatcattaaataaccaataatccgctgaaatctgtttttgcaacaatgaactcaacataccagacccgcaaccaagctccaaaacactatctagtgacccatttggtaaatagtcttgcaaatgcgccattaaattaatcgtcattttctgttggattaaggcgtgcctgtcataatcgtttaatgctttttggaaagcctgccgaatgcgcgatttatctacggaagttaatgatcccataatgccgaccagtgggtaaatcttgaaaacacataatgctcaccctctatttcctgaactgcacaacgcaatgcccaatattggtgctgattagctggcgtaaaaattttatcgcgagaactaacccatgcatttgcccagtgaataagatctatgcgtttatcctgctgaatcatcgcaaaaagtgcggtaagttcttgatgaatttcgtcaaacggacgggctggaaataattggtaacgttcaaaagatgctttatcgccacagattctgcgttcaaattttaaacgggtattttctgtgagattctctagcgtacctttaaaaatagcgtagggaataccgaagctatcatcacaaggtaaacctgtgccattcactgccgttgcggattttaatcttattccttgtaatactcgctctgccacccaaacgcccatagaccacgccaccaaacggatgtgccgataggcggaaagatcaaaatccaaatttaaatcttgataatcatagcaaatcaataaatcgtgattttccggcaaaatcaaatgatttacagcatcgggcggcgttccccaacctgcaaaatacaggattaaatgttcgccttggtaatcgtaaaatttcgttttcatatcatatatttataaatgcaccgcaaactgccgcacttcatctgccgtcatatcggcagttagagacaggcggattctggatgtgtttttgggtactgtcggcggtctgattggcaaacaataataaccttgctcttgcagatctttcgccttagcaagggttgcttcgttctcgcctaaaatatagggaacgatgcaagtttggcttggcattatttgcgttctgtgttccacttcttggcgtaaaaatgcacttaactgctcaagatgcgttctttcttttgaaagttgtggtaatcgttcaaaaataaaatgagtccacgccacattaaagggcggaagtgcggttgaaaaaatcaatggacgcatttgattaatcaaacattcttttaatatttgatcacagacgacataagcccccattgaagctaaggccttgccaaaagtgccaaccaacaaatctatatcagctatcacattagctcgttcggcaatacccaatccgttttgcccataaacaccgacggcgtgggcttcatccacataaagataagtattgggaaattgtttttttaattgaacaagctgtttcaaatccgccacgtcgccgtccatactgaaaacagattcggtaacgataaaagtgcggtcaaattttccgacgtttttttcaagcagatttttcaaatgttcataatcattatgacgataacgaaagaactcacattggcttaaacgaatgccatcaatcatgctggcatgcactaatttatctgccaaaatcaaacttttcgtcgtcgtcaaagcaggcaaaatgccgatattggcgtgatagccgctgttaaataataacgcactttcccgttggaaacgttgtgcgacaagctcttccaaatcggtataaataggaaagttgcccgttaataaacgcgatgaagaactggtaaaagagggaaaattaccgccatattgctgtaaaaaagactggcgcaagttttcatttgatgccaaacctaaataatcattagatgacatattcagcattttgcgattttctcgcgtaatatatcgtccttgatgaactaaatctggaattgaacgatattgattttttgcgctaagctgttccagttgctgtttgaaagcatccattttttatcctaatgttcatattcctgagttaaagccagaatcatgccttccgttaatttctgaagttcatcatctttaatcacaaatggtggcataacataaaccaattttccgaaaggccgaatccaaacaccttgttccacaaaacgtgggactaaagttttcatatttaccgcacttttcatttcaaccaccccaatcgcccctaatgcacgaacttctttgacgtaatctttttcagataaaggcgaaagctgttgttttaaggaagactcaattcgctgaatattttgctgccaagggctttccaacaataaacggatagattctgctgcaatcgcacaagccaacggatttgccataaaagtgggcccgtgcataaagcatttagcctcaccgctacaaatagtttgcgcaatttcagtggtcgtaatgcttgcagataaagtcaaatacccacctgttaaggctttaccgatacacataatatctggcgaaatgcctgcgtgttcagctgcaaataattttcctgttcgaccaaatcccgtggcaatttcatcaaaaattagcaatataccatattgtttacaaagcgcttgcgctttcactaaataagttggcgaataaaaatacataccgcccgcaccttgcacaaccggttctaaaatcagtgcggcgatttcattaccttttttcttaagtaaatcagctaaaggttcaatggcacaatcattccaagattcattaaatggaatgttgggttgaggaagaaaatactgcacgggtaagctatgatgaaataaatgatgcatccctgtggttggatcacacactgacattgcattccaagtatcgccgtgataaccagaacgaatagtggcaaatttttgtcgttgcacttctcctttagcgtgctgatattgaatagccattttcatcgctacttccactgcaacagaaccactatcagcaaaaaagatcttatctaatccattgggcaaaatttgtaccaataattgagctaattccaccgctgggtcatgggtaaatccgccaaacataatatggctcatttttgctaattgattctgtgccgccgcatttaaacgaggatgattataaccgtgcaacgccgcccaccaagaggacataccatcaatcaaacgacgaccatcttttaaagttatcatcacgccatcagcacgttccaccgcataaagcggcatatcagaagaaactgaagaataaggatgccaaatatgttgtgtatcaaaagctaaaagtgattgttcatccaccatttatttaccattaaaaacttattcgtatctcaaagctgctgcaggttctactttcgcagctcgataagcaggataaagggttgaaagcaaggaaagtaacagcgaaaatccaatgacaaaaatcatttgaacaaaggataattctgtcggtaaaaaaacaccttgtggatttaccgcacttacaatgtccgttaaattcaacgtagctaaaacacctaaaatagcaccgagtaatgtgccaacaaatcccaccagtaatccttgataaatgaacactgaacgcacttgggattttgttaagccttgagtttgcaaaatcgcaatttccccttgtttatccaccaccatcaaacttaaagaggtgacaatattggaaatcgccacgacaataatcaaactaatcagcaaacccatcatatttttttccattctcactgcttggaaaaattcgcctttttgcacacgccaatctgtgattttttgtgtcgggaaatgttgtgggagttctgtaatttggaacggatcattcagaaataaacgatagccctgtgcttgctgaggttgaatacgcattaagcgaccaatatctgtaatattagcaaaggcttcgtaaccagatgcttcgccataaccataataaatatcgctaacagtaaataaacgctgcattggcacccgaccgaatggtgtatattggctattttccgtaatcatcaaacggattttatccccaatattcacgcccagtttttgcgccagttgatcgccaatgaccagtttaaactcccctctaggcaaaatttcattaaatttagtctgatcaaaagattcaaccaaaggatcatcagaaaatgattgaatacctataatttgtcctgcacttacgccttttgccgtttgataaatcacatttgttgtattgatcggcacggctttttggacaaagtgcggtaaattttctagcgttttttctgtagaaataggctgctcttcgctcacaatcgcatgaggaatagaagatagcacctgttgtttttggtaaccttctaatccattcatcaccgaaagcacgatgatcaatgccatcacacctagcacaatccccaggcttgcaagattagtcactaatcgcccaaaacgatccgcacttttcgcacgccaataacgtagtgcaatataaagagaaataggaaaattcattatttttgatgtaattgttgtacaaattcttcgatgttttgcattactttgccaactaatgttgtcactgcactatcactcgcccaagcaatatgtggtgtgataattaaattaggcatcgtttttgcagctaaaattaacggattatctttttctggtggctcttttaccattacatccaaagccgctccgcctaaatgccccgtttttaacgcatcaactaaggcaagttcatcaatcaaaggcccacgccctgtattaatcaaaaatgcaccttttttcattttggataaggtttctgcattaattaaatcctttgttgtttccgttaatgggcaatgcaacgtcacaatatccgcttgttttaatacttcatcaaaaggcgtataaccttcacggcaaacagtggcatctttatgttctgcataaagcactttcattcccacggcattagccaaacgccccacttctgttcctaggcaacctttaccaaatacgcccaacgttgaaccgcgcacatctgtaattggataatcaaaataacaaaattgtttactttccgcccattttgcttccgtttgatcgcgtaaccaacctgccaaactgtgttttaaagaaaaaatcagaccgattacgtgttctggcacggttgtactggaataacctgtcacattacgcacggcgatgcccatttcttctgcagccacaagatcaacattatttgtacctgtcgcagtaatggcaatcagctttaattttggcagttgttgcaaagtttcacgatcaaaaatcactttgctcgtaatcacaatatctgcatcctttacgcgttcaatcgtttgctcagcagatgtatgttcatattctgtccaagtatgttcaaaacttgggcgaggaattgaaatatgtttaggaatagccgtgctatctaaaaatacgattttcattaattgctccttttttatatacaaagtgcggtcaaaattaaccgcacttttgatgaaatttaaattgaggtatccaattctggaaaagattttactaaatcatcgatggctttcatttgggaaacaaagccttcaagcgcagaaagtggcaatgcagaagggccatcacattttgcttgatttggatttggatgtgcttctaagaataaacctgcaatgcctactgctaaacctgaacgcgctaattcggttacttgtgcacgacgaccactcgatgctgccccaaatggatcacggcattgaagtgaatgggttacatcaaaaataacagggctacccttagaggcttttttcattacactaaagccaagcatatccacaattaaattatcgtaaccaaaatttgttccacgatcacaaagaatgattttatcgttaccacattcttcgattttttccacaatattacccatttgacttgggcttaaaaattgtggttttttcacattaatcactgcgcctgtttttgccatcgcttcaacgagatctgtttgacgcgccaaaaaggcgggaagttgaataatatcgacaacatcagcaacgggctgacattgatagatttcgtgtacatcggtaataatttttaccccgaatgtatcttttaattcttggaaaatttttaatccttcttccatgccaggtccacggtaagaatgaatagatgaacgattcgctttgtcaaaagacgctttaaatacataaggcacgccaagtttctctgtcactttcacataagcttcgcacacttgcattgccatatcacggctttccagcacgttcattccgccaaaaagcacaaaaggtttgtcgtttgcaacatcaatattgccaatttttacaattttattttgcataaattttccttaaatcaatggaggggaaaagtatctttattaatctcgcctttaagttctaaaagttgcgtgcggataaacgccgccgttggatcttttggacaatgttccacaaaaaattctaaatctttcaatgctgaaggataagcccccatttgagctaaaactaagccacggtcacggatatgataaggattttcagcatcagtaatcattaaattcttaatatagtgatatgccatatcgttatgctcttcacgaataagcgcatttttcgccagttgctcaaagcgagaataaagtaaagaaagatcggctctatcaagttcttcgggttgaattttcgccccaaacccaaatgcaccttcataaagttgctgcaatttttcttgtgaaatataagtgccatcccaaggatcaataaaagccacttcatctctgacttcagcacgtaaaattaactgtgttgggaaatttactgggtaaattggcaaatccaatgcctcagctaaataaaacaccattgccccaagagtcactggcattccttgacgatgttcaaacacataaggcaaatataaattgcgagcataaaaataatcttctggatcgcaatgaaagccccaatcaccataaaatagctgtagtaactgatgaatctgctcttctttcggccaatctggcgaaatttttttacgcgctttacgcacaagcccacccatttttccccgaagttgtgcttctgagctgccatcatcagagataacaagataaaaatgcacaaatttatcgtataacgcacgtcgataatatttcattacttcttccaaaaacctaaagtgacacgctcattgtcgctataatcacgcacagtttcaaccatttcccaatgattttcttggaaaattgaccgcactttttctccttgttgccatccgtgttcaagcaataatacgccattagaattcaaataactcgatgctaattcaataatatgacgtaaatcagcatacccctcatcattggcaactaatgcagaaaggggttcaaaacgcacatcgccttgatgcaaatgttcatcttgcgcatcaatataaggcggattgctgacgataagatcaaacttccctgttatattatcaaaccaacggctttgcaaaaattctacatttagctgatttctttctgcattagattgagctaatgccacaacatcggacataagatccacaccaattatttccagcggaatatgccgcttttggcaaatgggcgcaagctcggaagccaaagcgagggcgattgcgcctgtgccagtgccgagatcaagaatacgaaagtgcggtggattttcttccagtttttctaacgcaatttgtaatgccttttccactaaaatttcagtatctggtcttggaatcaatgtgccttttgagacatttaatggcaacgaccaaaattctttttcaccaagaatataagcgataggttcaccttttagacgacgatctaaaagtgcggtcaattttaaccgcactttttcatcaatctcagtatcatcaaaagcaaggatttgcgtacgcgatttgccagtagcgtgttgaagaagcacaagtgcatcaattttactattttcagtgggatttttttttgctaaatccgcaatcgcttgtgccagccattctttataattcattatttttcgtcttttaacactatcgtgccagccactaaatcagttaaagaacggcgatcatcgcgtacaagtgcaacaataccgctaataatcaataagaaacttgtccacgccaataaaatatcaataatctcacggccgatgtatttaccaaattcaacaggctgattggtatgataattaaatacgcgcaagcctaaccagcgttttgccattgtttgaccataagttttcatgaaatataactgaaaaccagcatatacaatcatccccactacaccggcaaaatcccccaatgcaaaaccgagaccagccatcacccaaagcacaagcccattaatcatacttgcaagccaacgtttaaaacggctcgcttgagcgagttgagaaggcttgaaagcagaagaaaattcagcatctttttgattttcaatgatcattttatttccttttaaagttaaaaaggacatctgaaatcagatgtccctatcattaattctgttcagacaatgcagccaactgatccgcttgatattcggtaataatcggctgaatcagttcatcaattttaccattcatcacttcatccaaacggtaaatggtgagattgatacggtgatctgtaactcgaccttgcggataattatatgtacgaattttatcagaacgatcgcccgaacctaataagttacgacgcatatctgtttgttctgcggcttggcgttcttgctctgcttgaacaatacgtgacgctaatactgacattgctttcgctttatttttgtgctgtgaacgctcatcctgacattccaccacaatacctgttggaatatgtgtaatacgcaccgcagaatccgttgtatttacgtgctgaccaccagcgcctgatgaacgataagtatcaatacgcaaatctgctggattaatttctggcatttcagattcaggcaattctggcattaccgcaacggtacaagcagacgtgtggatacgcccttggctttcagtttttggtacacgttgcacacgatgaccaccagactcaaacttcaactgaccatacacaccttcgccagtgactttaacaatcacctctttataaccgccttgctcactttcgttagcacttagcatttctacacgccagcgtttactttcagcataacgactgtacatacggaataaatcacccgcaaaaatacccgcttcatcaccgcctgttcccgctcggatttctaaatagcagttatattcatcattaggatctttcggcagtaaaagaatttgaagttgttgttccacttcttcaatttccgctttggattcttcgatttccatttgtgccatttctttcatttcaggatcgtcgagcaatatttcagcttcttcaatattttgatttaattgcgtccaacgattaaaacatttcaccacttcttcaagttgcgaatattctttagaatacgcacggaatttatcctgatcactaattacagaaacatcgcccaataaggcttctagctcttcatagcgttcttttaaactttctaattttgcaataatggaatctttcatcatttgtaagtcaccgaaaataaaatcggcgtattctagccgattttagggaaaattgacagcgaaaaggaaattaagaatctcagacgctttatttgtgatttacccactatttattggtgtcttgtttttgattgagctcacgatatttatcacacccttcttgactgcgtaaatcgcaagcatcgccaaaatattttttggctttggatttatctttttccaactcgcctagcttaattaacactttcggatctttacttaacaccaattcttctttaattgcttcaattttttcttgaagatcaggctgttttggcaaatcaaaaacacactaaaacaaggcgacaatatgcttgctaatcctagttgccaattatgctttgttgtactctctgtaaagagagtacaacacccagtatactgggtgtgaaatgattaaaaattgaactatttaattaggagggaattggagggcttaagactgaaaaaagtgagcaattttgatcactttctgccattaaatacacgtgacatcaaacttcgccaaattaatgtcatcttctgtgctataaaatgccactaacgccttgcgtaatgtttcagctcgttttggtaaacctttttccgcgtagattttcacttgttcatacacggcttgtttaaaaggctgtgtatcgcctggattgccattcaaattatccgcactggcaaaataacgaaaacctgccgccgtcgccaaaatccactctaatgcttgcggtttaacttcaactttttcaaagtcacgctggcgttcttctgaacgtccatctggctcataccaataaccaaaatcttctagtttacggcgttctttgcctgccactaaccaatgggcaatttcatgcaatgcactgctgtaaaagcctcgtgcaaaataaatcgcgttataaggcacttcatcatttgcgggtaaataaataggctcatcaccgcctttgactaagcgagtgttgtattcctcttcaaaacattgattaaaaattgcaataatatcttctaatttatgttccatggtatcgactcctaaaaaaccgcaagattatatcaccataggctcatttgttcttgtttattttcttcaggtaaattgacatgtaacccaatcaaacgaatcgatcgcccttttgctcgcataaaaatttgaggaagtaattgctgaaaactctccaaagaaagtggcaaacctgttttctccaaagtagttacttgaaaatcttcaaatttaagctttacgtataagttcgcgaatctttttgcataaaatcatcataatgattgctcctaaaataaaaagaagtacgcatagaatgatgcgtacttaacgtagggtgggctttagcccaccaaaatatctcacgattgtttgttggtgggctgaagcccaccctacaactactaaagcccaccaaaatatctctcgattgttttttggtgggctaaagcccaccctacaactactaatcaacaatcaacggctcgcattataggaaacaagcaggtttaaatacagaaaataataagaatagtttttatttcttgatttttatcaaaaatcaatctttattgttgtgagaaaatacctttcttcatataatatgtttgagaattattattattttttttataggactaaatatgaccaattttagattaaacgtgcttgcctattccgttatgcttgggctaacggcaagtgttgcttatgctgagccaaccaaccaaccaaccaaccaaccaaccaaccaaccaaccaaccaaccaaccaaccaaccaaccaaccaaccaaaatagtaatgcttctgaacaactagaacaaataaatgttttgggttcagataacaacaatgacaacaccccacctaaaattgccgagactgtaaaaacggcgagtcaattgaaacgccagcaagtacaggatagtcgtgatcttgtgcgctatgaaaccggtgtgactgtggtagaagctggacgttttggttcgagcggttatgccattcgtggtgtggatgagaaccgagtggcaattacagtagatggcttacatcaagcagaaaccctttcttctcaaggctttaaagaattattcgaaggttacggcaattttaacaataccagaaatagtgtggaaattgaaacgttgaaagtcgctaaaattgcgaaaggcgctgattctgtaaaagtgggtagtggttctttgggaggcgctgtactttttgaaacaaaagatgcccgagatttcctgactgaaaaagattggcatatcggctataaagcgggctactcaacggcagataatcagggattaaatgctgtaactcttgcaggtcgctaccaaatgtttgatgcattgattatgcattctaagcgacatggacatgaattagaaaattatgactataaaaatggcagagatattcaagggaaagaaagagagaaagcggatccttatacgattacgaaagaaagtacattagtgaaattctctttttcgccaacagaaaatccatcgttttacagtcgcctctgatacttatcttcagcattcccgcggacatgatttttcatataatcttgttaaaacaacatatattaataaagatgaggaagaacttcgtcatacaaatgatttgacaaaacgtaaaaatgtttcctttacttatgaaaattatactgttacgccattttgggatacgctcaagttaagctattcacaacaaagaattacaacaagagcaagaacagaagattactgtgatggtaatgaaaaatgtgactcttataagaatcctttagggcttcaattaaaagagggaaaagtcgttgatcggaatggtgatcctgttgagttgaagcttgttgaggatgaacaaggtcagaaacgacatcaagttgttgataaatataataatccttttagtgtagcctctggaactaataatgatgctttcgtaggtaaacaattatctccttctgagttttggttagattgctctatttttaattgtgataagcctgtcagggtttataaatatcagtatagcaaccaagaaccagagtcgaaggaagttgagttaaatagaaccatggaaattaatggaaagaaatttgctacttatgagtctaataattatagagatagataccatatgattttaccaaattctaaaggttacttgcctttggattataaagagcgtgatttaaatacaaagacgaaacaaattaatttagatttaacaaaagcctttactctctttgagattgaaaatgaactttcctatggtggtgtttacgcgaaaacgaccaaggaaatggtgaataaagcaggatattatgggcgtaatcctacttggtgggcggagagaacgttagggaaatcattgcttaatggattgagaacgtgtaaggaagattcttcatataatgggctactatgtcctcgtcatgaacctaaaacgtctttcttaattcctgtagaaacaacaactaagtctttatattttgcagacaatatcaagttgcacaatatgttgagcgtagatttaggttatcgttatgatgatattaaatatcagccagagtatattcctggtgtaacacctaagattgcagatgatatggtcagagaattatttgttccactccctccagcgaatggaaaagattggcaaggaaaccctgtttatacacctgagcaaattcgtaaaaatgcggaggaaaatattgcttatattgcacaagaaaaacgctttaagaaacattcttattctcttggggcaacgttcgatcctctgaattttttacgagtacaagtaaaatattcaaaagggtttagaaccccgacttcggatgaactttattttacctttaagcatccagattttacgattttacccaacccaaatatgaagccagaagaggcaaaaaaccaagaaattgccttgacttttcatcatgattggggctttttcagtacaaatgtatttcaaactaaatatcgccaatttattgatttagcttatctaggatcacgaaatttatctaactctgtgggtggtcaggcgcaagcaagggattttcaagtctatcagaatgtaaacgtagatcgtgcaaaagtgaaaggggttgagattaactctcgcttgaatattggttatttctttgagaagttagacggttttaatgtaagttataagtttacttatcaaagaggacgtttagatggtaatcgaccaatgaatgcaattcaaccaaaaacctctgttattggattaggatatgatcataaagagcagagatttggagcggacttatatgtaacccatgttagcgcgaagaaagctaaagatacttataatatgttctataaagaacagggatataaagatagtgctgttcgttggagaagtgatgactatacgctagttgattttgttacttatataaaaccagttaaaaatgtgactttgcagtttggtgtatataacttgacagaccgtaagtatttaacttgggagtctgctcgttcaattaagccatttggaacaagtaacttgattaatcagggaacaggtgcgggtattaatcgtttctattcacctggtagaaactataaattgagtgcagaaattacgttttaattaaactagagaaagcctgtgaaacaggctttctttttgcgtgaaagtgcggtggatttgacaaagatttatttaattaagagttggaagtagtcttgtatatcttccaaaatatctgcctcatcttgaggtgttaaaatcaagaaagggcgtgcaggaatcgctactttacgacctcgtccagctttaccgccgaattgatgaatagccgcgtaaggctcattcgtccccacaatggcttcattgttgttatattcagaagtaatgctcgccatcaagttttcagtatccaccaaaggcgtaccttggcgaatctttaatttcttccacgcaggacgaccacccacttcaaagttctgcgcgacagccgattccattgtgcccgcaatgctacgcattaaaggagctcgatgagcggtggcttgtgcaaggcgttctagtgccgatgtaatttcttgtgcgttattgatttcaatttctatcataatcgttgatttttaaaatttaagggggtatattttagtacgcacttagaaaagcgatgaatctcccagatcgcaagcgaagaggtgaaatagactcgggactgtgtgtaggtgtggggagccctacctaagtgcgtaatccttttctaatagctttttaagctccttgtcttttattcgtctaaacgacagcacaaagatttcttttggtaatattttcactacaagcattttcccttgtcgaataaaggtgtaacgatctgcaaaatctttcacttgtagtaaatgctcgggagcattgatgatatctggcaacgctcatactcatcaatcccaaaatcttgcccatcacggctattaaactgtttaattaaagtatcatcagaaagccacactgtgccagttttgcttttcaataaatccttactttccgcactcaagacacctgccgcaaatttaaaatttttggtaaggctatctcgcacctgtaacatctgctcagcagtgagtttttttccttcagggctgagcgtttgtttcatctccgccatatgctttgccaacaattcaaaatcgtgcttaaactccccacctttcatctcaaccttcgcaaacgcatgcgccagtttttcaggataaagatccaaattaggcttgtagtttaatcgccctacattgtaatcaaagcctttatccgtcacacgtatcgtgccatcaggcaatttaaaccctaccgtcttttcacgattaccttgcttatctgctgggcgttctacttccaccaaaaattcagaactgtcgtcaggcttatcaatcccacggcgtttcaaatctctttcgcctaaccttcctgcggttcaggaatccctaatttatcccacacccaactttccgaaatctgcacgccaatgcccgtaagtttagggatggcatctgcaaataccgataagtcttcatattcttttgtgtcaaactcaaaataagggatacgatgtggcgcaatattcggatcaacattaatttgcaaatacggcaaaatgatttgttgagtgataatttgcgcaaggtggcgcaatgacaaaacgttgtgatcagcctatttgtattgagtatgaagaatgcgaaccgaataaatacggtgagattcgtaagaaaattgtgggggtaaaaaacagattcacagaaaagaaaatcatcaccaaattaaaaaactgggtgattaaatcagcgaaaagtgcgttgggttccaccgcacttaattcggagaccaccgaacaaacaaggcgcatcgagccgcttggacttgtgtcaataactgtaaccgttcaaaaattgaacatcaagctaatctattgatgttgcctatcggttcgccattaaaaccgtcacaaattgaccttttaatgctccatggacggttacagcttaatgactatcggtggatttgttgtgaaaacgatgaagttttcattaaagaagaaaaaattccgttggctcaagcctttggttggggtcagatcataacccgcctttgttttatagccttctgccatatcaggtgcgtaataagtattttgcagaatactgagatctctatggcccgatattttggctaataccattacatccactttttctgccaatcgttcacggcgggtgtcgtgaaaatgtaaattggcattttcaagcccttccatctttttgagcttgcggaagttgtgatccagttggcgtgcttccatttggaatactcgcggatcactttctgtttttaccgaagtaagatgttgtaaaatctctattgcttttaccgaaagaggcaccgtgcgtgaatgtccatttttagtaattggcaaaaaggtggtgcgcttttcaaaattaatattattccaagttaaacttgctatttcccctgctctcattgctgtctctatagcaaaaagaaatgccgcccccgtgcaattttgtaaggtttttggcggttcaatatgttcgacatcataacctgacacaaaaatcagacgctcaatttcatgttcattatatcgacgagttcttggtgctggcgcttttggtttctcaagatattttagggggttttctgttataaaatcccattcaatcgttttggccattagagcagaaagcgaactacgttcacgcaaaactgttgttggagagacttcttttaatcgttgattttaccactcacgaaagtgtgcttttcctatttcttgtaaagatattgcggcaagcggagttcgagaaagacgcagtagtcttatgcgctcttcacgtttcccgcgcttggttacagtgacttcttttagatacttatcaatgagttcatccaatgtaatatcagggatttcattatactttcctgattcaagctgtttttcgagcatttctgcccatttttttgcgtctgcttgagtcaaaaaaatggctgatttgctcacgccaaacttgcgcacttgtgcgtgccaacgcttgccattcttgataattgtcgccatggtttattccataaaaatgtgtgcaatggagtatagaacagatcgaaatcgatcccaatcggtataaaaatactaccttttaggcgattttgatataaaaaagaaggtatgttttagtgtgttaaattatataagctattgtttttacttatattttatctatttttatctgaaaattggggaatagagaaaaatagagatggtgcgactagctggactcgaaccagtgacccccaccatgtcaaggtggtgctctaaccaactgagctatagtcgcactgtgtgaagtagtcgtgattatagatatttttaacttgaacacaagtatttttcttaaaacccgatataactggcaaaaaagtaaacaaaaccagcttaaataactgagccgtttttgatttccaaaagttttaagcgtataatgtgcaccgattttttatctggctaatatgtagcgaagtaaaataacacctttaaaattttgtaattattgacggagtaaataatgtctagaagactaagaagaacgaagattgtatgtactatgggcccatcaactgaccgtgataacaatcttgaaaaaattatcgcagcgggcgcaaacgtagttcgtatgaacttctctcacggtacacctgatgaccatatcggacgtgctgaacgtgtacgttctattgcgaaaaaattaggtaaaaccgtggcaatcttaggtgatttacaaggtcctaaaattcgtgtttctacttttaaagacggtaaaattttcttaaacgttggcgataaattcattcttgatgcagagttaccaaaaggcgaaggcactcaagaatccgttggtttagactataaaacgcttcctcaagatgttgtgccgggcgatattcttttattagatgatggccgtgttcaattaaaagtattatcaactgatggtgcaaaagttttcactgaagttactgttggtggtccattatcaaataataaaggtatcaataaattaggtggcggtttatctgcggatgccctaacagaaaaagataaagccgacattattaccgctgcacgcattggtgttgatttcttagccgtttctttccctcgttcaagtgcagatttaaattatgcacgtgaacttgctcaacaagcaggtttaaatgcaaaaatcgttgctaaagttgaacgtgcagaaaccgttgctaatgatgaagccatggacgatattattttagcctctgatgtaattatggttgcacgtggtgacttaggtgtagaaatcggcgatcctgaattagtcggtgtacagaaaaaattaatccgtcgttcacgtcaattaaatcgtgctgtaattacagcgactcaaatgatggaatcaatgattagtaacccaatgccaactcgtgctgaagtaatggacgttgcaaacgcagtattagatggaactgatgcagttatgctttctgcagaaacagcagctggtcaatatccttctgaaacagtggcagcaatggctagcgtatgtttaggtgcagaaaaaatgccaagcattaacgtttctcgtcaccgtatggataaagaatttgaaactattgaagaatctgttgcgatgtctgcaatgtatgcagcaaaccacatgaaaggtgtagcggcaatcgtcactttaagtagcacaggccgtactccattattaatgtcacgcattagctctggcttaccaatctttgctttatctcgtaatcaagaaaccctaaacctttgtgcactataccgcggtgtaacaccaatttatcacggcgaagaaagtcgtacagaagctggtgcaaaagcagcacctcaatcattaaaagaaaaaggttatttatctactggcgatttagtgctggtaacccaaggtggtcaaggtgcgacacaaactaacgtatgtcgtacattaattgttgaataatcaacaatctaaatatgttaaaataaaagagcggtggatttttccaccgttttttatttccttttttcaccgcacttttcacttaaanccaatagatatttgcggtatcatagacgacattctagtatcgaaataagtcctatggcatcacaacctcaaatcaaatcttcagacaaaaaaacagcacaagttagcattcctccgcactcaactgaggctgaacaagccgtgttgggtggcatcatgctgagcaatcaacattgggatggcattgctgaacgtgtgattgctgacgatttttatacttttcagcatcgtctaatttttacagaaatggaacatctaatgcgtaatcaatcgcctattgatttaattacgctagatcaagccttaagaagccgtggtgtaagcgatgaagtaggtggatttgcctatctagcagagctttccaataatactccgaacgccattaatattttggcttatgcagatatcgtgcgcgagaaagccatattacgagaacttatttcggtagggaatcgcattgctgaaaatagctattctcctaaagggcaagacattaagttaattcttgatgaggctgagcgtgaagtatttgcgattgcagaaaaacgtacgacttctagcgaaggcccacaaaatgtgatcaatgtgctagaaagtacgattgaaaaaatcgatattttaagcaaacttgaaaatcattcaggtgtaacaggtgttacgacgggctttaccgatcttgataaaaaaacggctggtttacaaccttctgacttaattatcgttgcggcacgtccgtcaatgggtaaaaccactttcgccatgaacctttgcgaaaatgccgcaatggcaagtgaaaaacccgttttagtatttagtttagaaatgccagcagaacaaattatgatgcgtatgatcgcttcccttgctcgcgttgatcaaactaaaatccgaacaggtcaaaatttagatgaaatcgagtggaacaaaattgccagcgtagtaggaatgttcaagcaaaaaaataatctttttatcgatgattcttcaggtctaacacctaccgatgttcgttcgcgcgcacgccgagtttatcgtgaaaatggtggattaagtatgattatggtggattatttgcaattaatgcgcgcaccagcattttcagataaccgaacactagaaatcgcagaaatttctcgctccctcaaagcactcgccaaagaattacaagtgccagtagtcgccctttctcagttaaatcgtactttagaacaacgtggagacaaacgccctgtaaactcagatttacgtgaatctggctctattgaacaagatgcagacttgattatgtttatttatcgtgatgaagtctataacgataactcggaagataaaggtgttgcagaaattattatcggtaaacagcgtaacggcccaattggtcgagtgcggttaaaatttaatggacaattttcacgcttcgacaatctcgccgaacaacgtgaatatcgagatgattattaaggaaaaataatgaacgtaaaaccggcgacagcgaaaattagttcgcacgccttaaaacagaatttagaaataattaaacaaaaagcaccaaatagcaaaattattgctgtggttaaagcaaacgcctatggtcacggcgttgtattcgttgcttcaaccttagaacaaaatgttgattgctttggcgtggcgcgtttagaagaggctttagcattacgctccaacggcattactaaaccgattttattgcttgaaggttttttcaatgaacaagatttgcctattctagccgttaataatattgaaaccgtggtacacaatcacgaacagcttgatgctttaaaacgtgcgaatttaccaagtccaattaaggtttggttaaaaatagatacgggaatgcatcgcttgggcgttgctcttgatgaagtggattatttttatcaagaactgaaaaaactccctcaaattcaaccgcacttaggctttgtcagccatttcagccgagccgatgaactagaatcagattacacccaacttcaaatcaatcgttttttatccgtcacaaaagataaacaaggtgaacgtactattgcagcgtcaggcggcattcttttctggccaaaatcccacttagaatgtatccgcccaggcattattatgtacggcatttctccaactgatactatcggtaaagagtttggcttaacgccagtgatgaatttaacctcgtcattaattgccgttcgccatcataaacaaggcgatcctgtaggttacggcggtatttggacaagtccacgagataccaaaattggagtggtcgcaatgggttatggcgatggttatccgcgcgatgtgccagaaggtacacctgtttatttaaatggccgtcttgtaccaattgttggacgtgtgtcaatggatatgcttactgttgatttaggcgcagatagccaagatttggtaggcgatgaagtaattttatggggcaaggaattacctattgaaaccgtagctaaattcacaggcattttaagctacgagctaattacaaaattaacacctcgtgttataactgaatacgttgattaatcactgcattttttgaacagagggagtcattctccctaataaaaattccagaaagtgcggttaaaatttcaattatttttaatgaaaggaaataccatgaaaaatattaacccaactcacacccatgcgtggaaatctctcgaagcacataaagctgaattgtcaaacatcaccatccaagatttatttaaacaagaaaaaaatcgttttgacgattattctttaacattcaataaccaaattcttatcgatttttccaaaaacaacatcaatcaaacaaccctttcacatcttcgccaacttgctcaagaatgcgcgcttgatagcgcaaaagaagcaatgtttaccggtgaaaaaatcaatcgtacagaaaatcgtgccgtactacataccgcactacgcaatcgcactaatacgccagtgcttgttgatggcaaagatgttatgcctgaagtcaatgctgtgctagctaaaatgaaagatttctgtcagcgtattatttctggcgaatggaaaggctatacaggtaaagccattacggatgttgtgaatattggtattggtggctctgacttaggcccttatatggtaaccgaagcacttcgcccgtataaaaatcatctaaatatgcactttgtttcaaatgtcgatggtacacatattgcggaaaccttaaaaaaagtcaatccagaaacgactcttttcttagtagcatcgaaaacttttacaactcaagaaaccatgacaaatgctcaaagtgcgcgtgattggttactaaaagcagcgaaagatgaaagtgcagttgcaaaacattttgcagcattatcaaccaatgctaaagatgtagaaaaatttggcattgataccaataatatgtttgaattttgggattgggttggcggtcgttactctttatggtcagctattggtctttcaattgcactatcaattggctttgaaaactttgaagcgttattaaatggtgcgcatgaaatggataaacatttcctctctactccaatcgaacaaaatatcccaaccactttagcattagttggtttatggaataccaatttccttggtgcgcaaacagaagctatcttaccttatgatcaatatttacatcgcttcgcggcttattttcaacaaggtaatatggaatcaaatggtaaatatgtggatcgtgatggcaatgtcattaaaaattatcaaactggccctatcatttggggagaacctggtacaaacggacaacacgcgttctatcaattaattcaccaaggcactactttaattccttgtgattttattgcgccagcccaaagacataacccattggcagatcatcacaataaattgctttctaacttcttcgcacaaacagaagcattagcattcggaaaaacaaaagaggaagtcgaggctgaatttgtaaaagcggggaaatctttggatgatgtgaaaaatattgttccatttaaagtattcactggtaataagccaactaattcgattctcgttcaaaaaatcacgccatttactttaggggcattaattgcgatgtatgaacacaaaatcttcgtacaaggtgtgatttttaatatctttagcttcgatcaatggggtgtagaactaggcaaacaacttgcaaacagaattcttcctgaattaacagattctgaaaaagtagcaagtcatgacagttcaactaatggattaattaatcaatttaaagcatggcgttaattatttggatttgaataattctagagctgtcacaaataacgactaaaaactctatttaggttaagataatcaaatgagagaaagtcgcttaagtcaatataaacaaaataaacttattgaaatatttctggcaagtgtgacagctctagccacagctaagttggtaaatataaataaacttcagcttattactttcatcgtctaccattgtttatcactcaaagcagcctacatatggaaatgtttgaaagtgaaattcaagcgaatgaaagctattttggtggtgctctgaaaggtaaacttggtcaaggagaagctggaaaaacttccgtaatttgttttttgaaacgaaatggcaaagtaacaccgtggtggttatgaatatgcaatctgcaacactgttaccgattattcgagaaaataaacaaggtagtattattatatgaatttctacagaggttatgatattcttaagctatatttaaaggaatatgaatggcgttttaatcacagtgatttaaaaaaactcaaatttctatttcaaaacaattaatttaggagagttttaattggttatctatgcatctccttttgttatttaaataacgtataaaatagtttaaagaagagtgtaaaattagagcttatatggaaaattgtccattagtatcggttattgtttgtgcttataacgctgagcaatatatagatgaaagcatttcatccattattaatcagacttatgaaaatctagaaattatagttatcaatgatggttcaacagatttgactttgtctcatttagaagaaatatctaaattagataaaaggataaaaattatcagtaataaatataatttagggttcataaattctttgaatataggccttggttgtttttcaggtaaatattttgcaagaatggatgctgatgatatagctaaaccatcgtggattgagaaaatagttacctatctggagaaaaatgatcatattacagcaatgggatcatacttagagattattgtagaaaaagaatgtggaattatcggttctcaatataaaactggagatatatggaaaaatccattgctacataatgatatttgtgaagctatgcttttctataatccgatacataacaacactatgattatgagagcaaatgtatatagagagcataaattaatctttaataaagattatccgtatgcagaagattataagttttggtcagaggttagtaggcttggttgtttagctaattatcctgaagcattagtaaaatatagactacatggaaaccaaacatcatcagtttataatcatgagcaaaatgagacagctaaaaagataaagagggaaaatattacatattaccttaataagataggtatagatataaaagtaattaatagtgtgtcgttgctagaaatatatcatgtggataaaagtaataaagtgttgaaaagtatactttatgagatgtatatgagcttagataaatatactataacttcactcttacattttattaaatatcatcttgaattatttgatttaaagcaaaatttaaagattataaaaaagttcataagaaaaataaatgttatattttagatagagtgttcagaaaggggaaccaaattccaagttttctaaaggactaaattctaatttagtcctttaaatttatcttagatagacgataatatatattttaaatgaatttaattataaaaaaatcagtgccttactaagttaagacactgattaatcatattagactttaatgctattggttatagcacagaaacatttaagcttgagccgccaccaacaaatacgaactcggcgaccaagctacaaaaactgctgtcagccttttgaacaacaacgatctcttgaccatcatctttcttaattacaagttcagcaccgtttacttgactcattttttcttcgattttacttccagctattgcaccgccaattgcaccaactactgctgcaatagcttgaccacgaccaccgccaattgtactaccagcaataccacctaaagctccaccaccaagcgtaccaactacaccttgattatcagcttgaattttaacagggcgtacagaaacaatcgtaccataagtaattgaacgcgcttcctttgcttgagatgcgctataaacatcaccgctgaaaatatcagtatttgcacaaccagttacactaaaagcaactaacagtgctaatgccatatttgtttttttcatataatattctctatattagaaggaattaaagtgggtttcttggagaaaaagttgaaatgtttttagtattaccattgtcagatactaaaacacaagcaccaacaactaaagttgaaccatacttatgcacaataacaacctcctatcctttctgctggttaccagaacaatcatttttacgaacagttaattttagatttttgccttccatttgactaaaaataatttgacctttataagtcccctcctccttttgaaaagcagaacaagcactcaagtctactgttgctaaacaacgaatgcaagtgataatttattcatttttactaaacctcaagtatttttttatagaataaggatgaaccttaatgcaagtatgatttactgttttatccgtaaaacttactgcaatagatggatttggtaatctttccccatccactttaggctcgctcactttaatggttaattgagttaattgtcccataaaaaatacatattaacacggttaatccattcatttatcgattctttcggtaaaaatggcattacaatctcaatatgttcccagccctcaattggatattttttatttttaggaagtggaagttcaataatatccacaaattgattggcaaatttaactggtttttctaattcaataagataaatcttacgaccattaacaatattatcagataaaattctaccgcactttaataaaagtatcagccaatttttagcactttgctcactatttacccgtaatgcaagatgatcaatttcatagtgagacagatctattgtcatttctttggctaaatgctgaatttttctttcaaatattgctaaatctgctgaaagtgcggttaaattttcctgtaaatttgtcattttgtccctttgagaaatatacaaagaacggtatcataaccgattatttttattattcaatttgaacataggaaaaaacgtgaatattcaatctattctatccgataaaattaaacaagcgatgattcttgcaggtgctgatcaatcttgcgatgcgcttattcgtcaatcaggaaaaccacaatttggcgattatcaagccaatggcattatggctgcggcaaaaaaattaggtttaaatccacgagaatttgctcaaaaagttttagacaatcttcaactatctgatattgcagaaaaattagaaatcgcaggtccaggttttatcaatattttcttaaatccaacttggctaacaactgaaatttcagctgcactttcccacaaaaatttaggtattcaagctaccaataaacaaacagttgtgattgattattcatctccaaacgtagcaaaagaaatgcacgtaggtcatttacgctctacgataatcggcgatgctgtagccagaacccttgagtttttaggtcacaatgtcatccgagctaaccacgtaggcgactggggaacgcaattcggaatgcttattgcttatcttgaaaaaatgcaaaacgagcatgcgagtgaaatggaattacaagatcttgaagccttttatcgcgaagccaaaaaacactacgatgaagatgaagtattcgcagaaaaagcgcgtaattatgttgtgaaattacaaagtggagatgaatattgtcgaacgatgtggaaacgtttagtcgatatcactatgcaacaaaatcagcacaactatgctcgcttaaacgtgactttaaccgaaaaagatgtaatgggcgaaagtctttataatcctatgttaccaagcattgtaaaagatcttaaaaaacaaggtttggctgtggaaaatgatggtgcattggttgtttatttagatgaatttaaaaataaagatggcgacccaatgggtgtaatcgttcaaaaaaaagacggcggtttcctttatactacaaccgatattgctgcagcaaaatatcgttatgaaacattaaaagctaatcgcgcccttgttttttcagatactcgccaaagccaacatatgcaacaagcttggttaattactcgtaaagcaggttatgtaccagatagtttctcgttagagcataaaaactttgggatgatgcttggtaaagatggcaaaccatttaaaacccgtactggcggcacagtgaaattggccgatctattagatgaagccattgaacgcgccactgtattaattaatgaaaaaaataccaatttatctaatgatgaaaaagaagctgtgattgaggctgtcggtattggtgcggtgaaatatgccgatctctccaaaaaccgtactactgattacgtttttgattgggataatatgttaagtttcgaaggtaacacggcaccttatatgcaatatgcctacacccgtattcgttcgatctttaataaaacagatataaattcaaccgcacttttggctgcacctttaactattaaagatgataaagaaagaacgcttgctattaaacttctacaatttgaagaagccgtgcaaactgtcggaaaagaaggcacgccgcacgtgctttgtgcttatttatatgaacttgctggcatcttctcgtcattctacgaacattgtccaattttaaatgctgaagatgaatctataaaattaagtcgtttgaaattagcattattaacggraaaaaccttaaaacagggtttaacgttactcggtattaaaaccgtagaaaaaatgtaatttagataattaaaatccctttctcaggaaagggattttttatacttgtttactgaataaaaaaaagccccattggggcactactcggaaagcaaaatagatgtcggctatttaagatagcacttgtttttagtggtttcagawtaaagaaatccgatcagttatgcaaatacatatttttagatttgtgaacttggtcacgatttttttataaaaaaactaaaaacaaatatatttctaataaagtgcggtaaaattctattaaaatatttccgcactttacgcccctactttaaagaatattcttttctccacgagacacactaatcaatccagaacgaacaatttctaacaatgtagtttcttctttcaatgcagaaataaacgcatcaactttatcatttgtaccgcttaattgaattgtgtaagactttggtgttacatctacaatttgaccgcggaaaatatctgctaatcgtttaatttcatcgcgagatgaacctactgctcttactttcgctaaaacaatttctcgttctatatgttcctgctcacttaaattaaccactttaaacacatccactaatttatgaagttgtttttcgatttgctccaatgcctgagcatcgcccacagcttcaatggtcattcgagaaagcgttggatcatccgttggtgcaaccgtcaaactttcaatattaaaggcacgttgagagaataaaccaacaacacgcgacaatgctcccgattcattttcgagtaaaacagataaaattctacgcattagtttgtctcctcttgaggtttacttaaaatcatttcattcattgcaccaccacgaatttgcattggataaacgtgttcagattcatctacattaatatctacaaagactaatttatttttaatactgaatgcttcttgcaatttgctttcaagttcatcgggggtagcaatttttattcctacgtgaccgtaagattctgccaatttcgcaaaatcaggcaaggaattcatataggtttgcgaatggcgaccagaataaatcaaatcttgccattgttttaccattcccaagaaatgattattcaaacaaataatgacaacaggaatgccatattgtgttgcggtagaaagctcttgaatattcatttgaatactaccatcgccagtaacgcaaacaacagttccttcaggatgagctaatttaacaccaagtgccgcaggaaaaccaaaacccattgtgcctgcaccaccagaattaatccaatgacgcggttcatcgaatggataatgtaacgcagcaaacatttggtgctgacctacatcagaagccacataagcttgtcctttcgtgaggcgatataccgcttccacgacttgttgcggtttaatcacgccagaagtgcggtcaaattccaaacatttttttgctttccattggttgatttcttgccaccaactttcaagatctgtttgagattttaatccctcttcattcaataaacccaaaaattcttccaatacatttttcgcatttccgacaattggaatcgctactggcacatttttagaaattgaggttggatcaatatcaatatgaatcacttttgcatttgggcaatatttttctaaattatttgtcgtacgatcatcaaaacgaacgccaatccccaaaataagatcactttcgtgcattgccgtattcgcttctaaagtaccatgcatacccaacatacctaagaattgtttatccgtacttggataagcacccaatcccattaatgaggaagtcacgggtaaatttaaacgttgtgcaaactgaattaactgctcactacattcagcagtgattgcaccaccaccgacaaaaagtattggtttcttcgccactaaaagtgcttttaacgcttttttaatttgacctttgtgtccatttactgttggattataagaacgtaactcgacatattcagggtattcataaggatatttaaaattaggatttacagtgtcttttggaatatccacaacaacaggacctggacgacccgtagatgcaatataaaaggcttttttcaaagtagatggaatatcttccgcctttttgacaataaagctatgcttcacaacgggacgagaaatacccagcatatcacattcttggaaagcatcactgccaattaaattgctcataacctgacccgaaatgataaccataggcacagaatcggtataagccgttaaaatgccagtgatagcatttgttgcaccaggccccgaagtcactagcacacatccaactttacccgttgaacgtgcgtaaccatccgccatatgcaccgcggcttgttcgtggcgaactaaaatatgttcaataccacccagcgtatganttgcatcataaatatctaataccgcgcctccgggataaccaaatacatactctacgccttcatcacgtaaagattgaaccaccatctctgcgccagataacttcttcatttttcactccttaaattcaccgcacttttaaaaaaacgaacagattatgtcaatgtttcacataatacaaagtaaaaaaaatttgtctagccactaaaacaacaaaaaaatcaattaaaaaaatataaaaaaccaaatataaatgaaaatttagttttttataaatttttccatcaataaaaataaaaaaatgcgacaaaatgccgcattttataaaatagtaaaaatattattttttattcaaatttttgaatgagatcacagttttagcgttttttaactgcaaatataatgacaatcaatgaaactgccgttgctgcaaaaccagctaaacctgaataagtaaaccctaccacaatgtaaccaatagaagtcgctgttgcaactgtggcagcataaggaagctgagtagtaacgtgatcaatatgattacattttgcgcccgttgaagacaaaattgttgtatccgacactggcgaacaatgatcgccacatacagcccctgccattactgcagataaacaaggaagcaataattctggtgcggcattcgctgccattgctgcggcaattggtaacataataccgaatgttccccagctcgtacctgttgaaaatgccatcgctgcaccaagaacaaaaagtataacaggcaaaaattgcattggaatattaccagacacaagagaagatagatatttacctgtttgcatatcacctactattttattaattgtccaagcaaagaataaaattgcgattgcacctgacattgatttaattcccacaatccaagaacgtacatattcaggaacactcacttgacgatcaagaataattaataaagtagaaataataattgaacagaatccacctacaaccaaagatgttcctactacggtgttttcaaatgtacctaaaacactaaacactttgccatccgcagccaatgcctctgcgcctgtgtaaatcatcattgaaactgtagcgataattaaaactaaaataggtaatataagattacgcacctgaccttttgtacccgtttcttcttccaactgatcttcagtatttttcaaagctaatttttcgtgacgcaccattgaagcaatatcaaaagaaaaatatgccacaaaaaacaccataataatggagaaaattgcatagaagttcattgaactcattgctacgaatgcaccaattggtgtgtactccgtgatcgaataagtcgctaataaaccgcctattaaagtaataatatatgcgccccaactggaaactggcatcattacacacatcggtgctgccgttgaatctaaaatataagcaagtttcgcacgagaaactttaaaacgatctgtcacaggacgagcaattgcgcctacagcgagactatggaaataatcgtcaataaaagtaacaaaaaccaatgatgccgctaataatttagcaccacgacgacctttaatacggctttgtgcccattcagcaaaggcacgattactacctgatacggttaaaagtgcggttaaaacaccaagcaataataagaacaaaacaatgttcatatttgaattgatttcaccatcggcataaaccaaagaaaccacattttttaccaaataattaaatgcgctgccgatttgccaatcgcttaacattaatgatccaataataatccccgcactaagggaaaccaaaacacggcgagttgctatcgccaaaattatcgccaacaaagcagggacgattgaccaaacagatgatgaaaaatcaataagttccattaaataatacctataattaatggagagaacggaaagcataggacagaataagaccagaacaaccgtagcactccatagttaatcagaaaaactatgacagtgtcgcccctttcgagcacgccaccaaccaaacaaaacgacttttatttgatttcggcaactattcctttcttttttcttcttcgttatccactctgaaaaaatacttataataattgcgcctctacttttgtagtgattggggagattaccgtaaaacaaacaaaatgccaacagattttataaaaattttataaactttaataaaaatataaagaaaataaacacaaaaaaatatatctgtttcgnccatttatttaataatagatatttacaataaattttattttctctattattaaataaattttcccacatttaatgttatttattgaggtttattatgaacgaattagtaagaggtttaacaaatcttcgtagtttacgtgcagctgtacgtgaattaacgttagaacaagcagaaaatgccctagaaaaattacaaacagctatcgaagaaaaacgtgctaatgaagcagaattaattaaagcagagacagagcgaaaagagcgtttagctaaatataaagaattaatggaaaaagaaggtattacacctgaagaattacacgaaatttttggcacaaaaactgtatcaattcgagcaaaacgtgctccacgccctgcaaaatatgcgtttattgatgaaaatggcgagcataaaacttggacgggtcaaggtcgcacaccacgcccaattcaaaatgcgttgaacaaaggtaaatcattatctgatttcgaaatttaatttttctatttgaaactagaacctattttatgggttctatttttttatctaaacatagcacacaacattatgatcgaaaaaaaaatattactcactgattgccctgatgataaaggcttaatcgcaaaaataactaatatttgttacaaacatcaactaaatattcttcataataatgaatttgtagattttgaaaccaaacatttctttatgcgcacagaattggaaggtatttttaacgaagctactttattagaagatctaaaatatagcttaccagaagaaacaaattgtcgattaattggcacccaacgtaagcgaattgtaattttagtcaccaaagaagctcactgcctcggcgatattttaatgaaaaattattatggtgcgcttgatgtagaaattgcagccgtaatcggcaatcacgataatttacgtgaacttgttgaacgttttaatattccatttcatttagttagccacgaaaacttaacccgtgtagaacacgacaaattactggcagaaaaaattgatgaatatacgccagattatattgttctcgctaaatatatgcgtgtgctaaaccctgaatttgtcgcacgttatccaaatcgagtgattaatatccatcattcattcttgcctgcttttattggtgccaagccttatcaacaagcctataaacgcggtgtaaaaattattggcgcaacggcacattttattaataacgaattagatcaaggcccaatcattatgcaaaatgtgattaatgtggatcatacttataatgcagaagcgatgatgcgtgctggccgtgatgtggaaaaaaccgtgttaagtcgcgcccttgatctcgctttacacgatagaatttttgtttataaaaataaaacggtggtgttgtaatggaaaaaattactcttgcaccaataagtgcggttgaaggaacaattaatttaccaggttctaaaagtttatcgaatcgcgcattacttttagccgccttagctaaaggcacaacaaaagtaaccaatttattagatagcgatgatattcgacatatgcttaacgcactgaaagcattaggcgtacgctatcaactgtctgatgataaaactatttgtgaagtagaaggattaggtggaacattcaatatacaggacaatctttcactctttcttggcaatgctgggactgcaatgcgtccattaaccgcagcactttgcttaaaaggaaaaaccgaaagcgaaatcatcttaacgggtgaacctcgtatgaaagaacgacctattcttcatttggtcgatgcgctacgccaagcgggtgcagatattcgctacttagagaatgagggttatcctccgctcgcaattcgcaacaaagggataaaaggtggaaaagtcaaaattgatggttcaatttcatctcaatttttgaccgcacttttaatgtctgcaccacttgcagaaaatgacacagaaatagaaattatcggtgaactagtctctaaaccctatattgacattacccttgcaatgatgcgagattttggtgttcaggttgaaaatcatcactaccaaaaatttcaagttaagggaaatcaatcctatatttcgcctaataaatacttggtagaaggcgatgcctcatcggcatcttactttctcgcagctggcgccattaaaggaaaagtgaaagtaacaggcattggcaaaaactcaattcagggcgatcgtttatttgctgatgtattagagaaaatgggggcaaaaatcacttggggagaggattttatccaagccgaacacgctgaattaaatggtattgatatggatatgaaccacattccagatgccgcaatgacgattgcaaccactgctctttttgccaacagcgaaaccgtcattcgcaatatttataactggcgtgtgaaagaaacagatcgtttaacggctatggcaaccgaactccgtaaagtcggtgcagaagtcgaaggaggtgaagattttattcgtattcaaccgcttccactcaatcaatttaaacacgccaatattgagacctataacgatcaccgtatggcaatgtgtttttctctaatcgcactatcaaacacaccagtgacgattttagatcccaaatgtactgccaaaacctttcctacattcttcaatgaatttgaaaagatttgcttaaaaaattaagtaaaaaagtgcggtcaatttcaaaacagttttcaaattaaccgcactttcattccattctaaaaaaatcctaaataaagattatttataccgttttttcaccgcacttttatcttgctcacgtaaccgttctagtttttccttaatctgaatttccatacctctatttgtcggaaaataatattgagtatcttttaattcaggtgggaaataattttcgcctgccgcataagcgttaggttcatcgtgagcataacgatattcagtgccatatccgagctctttcattaaattagtcggcgcattgcgtaaatgtggtggaacatcgtaatctggcaaatctttcgcttgctgtttcgcagtgttaaatgcagtataaaccgcattactttttggtgctaccgaaagatatataatggcttgggcgatggctcgctccccttcataagcccccacgcgactaaagcaatcccaagcagccaatgcaacttgcatagcacgaggatctgcatttcccacatcttctgaagcaatggcaagtaatcggcgcgcgacatataaagggtctccacctgccgttaaaattcttgcataccaatacagcgcagcatctggagcagaacctcgaacagatttatgtagcgcagaaattaaatcatagaaacgatcaccttgtttatcaaatctcgcttggcgttcgcctaagacttcttttaataaagtgcggtcaattttctttccattttccgtttcatccgccatatccaccattaattcgaggcaattcaaagctaatcgtgcatccccattaacatattcggcaagtacttgcagtaaattctcttctaaaattaaccgctctttacccaatccacgtttaggatcttctacagcttgctgcaaaacttgttcaatttcagccgttgtgagtgatttcagcacatacactcgggcacgagaaagcaacgcattatttagctcaaaagagggattttctgttgtcgccccaataaaaataacggttccgtcttcaatgtgcggtaaaaatgcatcttgctggcttttattaaaacgatggacttcatccacaaataagatagttttacgatccgcaagacgattttgttttgcacgatcaatggcttcacgaatttctttgataccactcgtcaccgcagaaattcgctctacttctgcattaatacgttgtgctatgatttctgcaagggttgttttccccgtacctggtgggccccaaaaaatcatagaataaatatgaccagcttggatagcttttcgcagtggcttgccctcgccaattaaatggctttgcccaaaatattgttctagactcgttggacgcatcttggctgccagtgggccaaaatcattttcggsaaaatcaaaattgaagttagacatttttatttctcaaaaaattgaagggcgtatttctacgcccttatttaaaataatcacttgttattttttacgttggtcatccacttcaacgcctttttctggcttgaattggaacaagctatcagacaaggtttgattcgtaatattacgtaaaacataaagattggtttgcccatctttctctgtcgtactgaaatttcgcaatattccattagcatcaacacgaatatcaaattgcttaatgttgcttgtggataaggttggttttaacacaaaggtatccgattgttgtgttaccgtatattgatgccaatggctcttatcattgctggtaagcaaaacaaaaggagtattatttaccgcattttttacccattgtgcggtcacttgttgcacaaatggatcgtagaaccataaggttttaccatcagaaataatctgggtttcttgaggggttttagtctccatacggaataaatttgggcgtttaatttgaagtttgccacttccttgttgaacattttttccacttccagaagtcactgtttgcacaaattctgcacttaatacatcgactttagctaaacgcatttgtaattcacttgccgcatcagccaatgccaaattactcaaaccaagtaaggtaagtgcggcaaattttaaggttgtttttttcattttactttccttttaaattagtattctggacgatgcgataaaatttcacgcttaccattttgcattgggctgacaatcccttgttcttccatttgatccataatacgcgctgctcggttaaaacctacgctgaatttacgttgaatagaagatactgaagttgtaccagtattaataacaaagtccattacttcatcaaagagtggatctaattccccaccgcttgatatccctttttctgaactttcctcatcgtctgcgctttctaaaattccatcaatataatcaggtttaccgcgtgctcgccaatcatcggcaatattgatgacttcatcatcactcatataggctccatgtacgcggattaaatcagatgaaccttgtccagaataaagcatatctccacgccctaaaagggcttctgcacccccttgatcaagaatagtacgtgagtcaattttacttgccaccgtaaaggcaatgcgacttggaatatttgctttaattaaaccagtaatcacatccacagaggggcgttgtgtggctaaaattaaatggataccgatagctcgtgctttttgtgccaaccgtgcaatcagttcttcgatttgcttacccgctaccatcattaaatcagcaaactcatcgacaataaccacaatataactcaattttttcaacgctggtggcattgcatccatcgtatcgcccagtcgccaaattggatttggcacaggcattcccattgcttcgtattcatcaattttttcattaaagccttcaatgtttcgtacgcgtaaagctgaaagcaactgataacgacgttccatttcatctacgcaccaacgcaacgcattagcggcttttttcatatccgttacaactggtgtcagtaaatgtggaatatcattataaacagaaagttcgacgactttaggatcaatcataataaatttcacatcttctggttgaacacgataaagtaaacttagaatcatcgtattcacaccaacagacttacctgatcccgtagaacctgctaccaataaatgtggcattttcgctaaatcaacaatgactggtttgccactaatatctttacctaaagcaataggtaaagttgccttgctatcacggaattcattgctatctaatacatcacgtaatggcaccatttgacgatgaagatttggggtttcaataccaatataaggtttacctggaatcacctctgccacacgaatagaacgaaacatcaatgctcttgctaaatcggtatcgatgctcgtgacttttgatgctttcacacccggctgtaattctaattcataacgcgtaacaacagggccaacaagcacatcttttacgctggcttttacattaaaattgcgtaattgttgttcaatacgctgtgaggtttccattatttcatctggtgtaatgcgttgttcatttggcggatattttaaaagcaaatccaaactaggtaatggtgtactcggtttttcacgttttgttgtttgctgttgaaatgcaggatgaatcaagctaccgctataacctttataattaggctcttgatttttgtctaattgaacggcttccatatcatcctgtaagataggttaaatttcactccatctttttctaaatctaccttttcattaacttgagtagcaaaatgattatctaccatttcagtattcaaagattcatgactgggtcttaataaaactgttggcatttcatcttttgttagcaaagaaacttgagtaaaatcatccgcactttgatttaattgctaaatcttcttgaacaactgtttttacaggcttattccaaactgcgacaaaatcatttttgcttaccctttgttcatctgaatcactcgataaattcacactaggcaagctttcagaatcaaacccaaaagaaaattgcggtttttcattctcttcgttcgcgagttcatattctgattttatagaaacctctggatttaacccgctaatattaattaaatgtgatgaagatttgccaattgaaatattttctgcttctaaggatggctttactgtttctatttcactattttgttctacattgagataattttgatctagattttctgtttctgaacgatctgattttacaatcacaatttgctctaattcttccgttgatttttcttgctcagcattttctgattgctcatttttcattgttagccaatgataaaatgtaacaattaatcgaattaatgatgtgccagaacaaaaaataaaaccaattaaagcaagcacaaaaccaattaaaattgaaccaaatttacctaatacaggataaaaccaatttacaacaagcgatccgcccaatacgccgccactcaaataaaaagtattacttgataaaagcaacatactcactacacaaagcccaataatcagcatggtaaagccaaaactaccgtaaaataattcgagtacaggaaagctgtttaactgcttttgttttcaataaataaataggcacgagaaaagcggtgaaaggaataatatgggcaacataacctaaaaaaacaaaaaaaagatcgattatccacgccccaaatgaaccgactttattaattgtgttgccatacgcactgactgttgcccaagaattatcaaggggcgtataacttgaccaagcaacaatcaaataaagtccaaaaagtgcggttaatcccagcaaaaattccgctaaatactgtcttggcgtaaatcgttctgtaatttgtttaatcatattatttcaatacaaggaaattggtttgttttacttcttccatcacaacataagtgcgagtgtcatttacacctggtaaacgtaacaatgtcgtgcctagcaattttcggtattccgccatatctgccacacgagtttttaataaataatcaaaatcgcccgataccaaatggcattcttgaatttcttccaacgcttgaatcgctgcattaaattcttcaaacacatcgggcttaccccgtactaatgtaatttcaacaatcactaacaatggcgcatccaataattctggatttaacagtgcgcgataccccataatcacaccttgtttttccaaacgtttaactcgctctaaacaaggtgttggcgaaagccccacttttttcgacaaatcaatattggaaatcttaccgttgcgttgtaattcattcagaatttttatatctatcgcatccaatgctttatttcgttttttttccattttctttatttctttgctcataaaaaggaacaactattctacagaattttcctttcattttcagtaggcgatgatttttttacaaattatctaacacagcgagcgcatccgtgagttttttcacagtaaaaacctgcatattttcgaccgcacttttcggcttgttaccaaaaggaacaatagcacgtttaaaaccgtgttttgcagcctcgctaatacgttcctgtccacttggcacaggacgaatttctcccgctaatccaacttcgccaaaaatcactaaatcttgcggcaaagggcgattacggaaacttgaaattaacgcaagcaacaaagctaaatccgcactggtttcactgacttttacaccaccaaccacatttacaaaaacatcttgatccgccatttgtaagccaccatgtcggtgtaacaccgccagtaatagcgctaagcgattttgctctaatcccaccgcaacacggcgaggatttgccagcattgaatgatctactaaagcttgaatttcaactaaaagaggacgagtaccctcccaaagtaccataacagaactgcctgacgtaatttcatctccgcgacttaaaaaaatcgccgatggatttttcacttcgcgcaaaccctgctctgtcattccaaacacgcccaattcatttactgcaccaaaacggtttttatgactacgcaaagtacgataacgagaatcggcttcgccttctaataacaatgaacagtcaatggcatgctctaacactttaggccctgcaagggttccgtctttcgtaacgtgtccaaccataataatcgccacttggcgagtttttgcataacgagtgagaaaagaagcgcattcacgcacttgagctacactgcctggcgatgattgaatatctgccaaatgcattacttggatagaatccaccacgataatttgcggttttaattgatccgctaaattacaaatctgttccacagaggtttctgacaacatttttaattgatcacttggcaatcccaatcggcttgcgcgcatcgcaacctgttgtaatgattcctctcccgttacataaagtgcggtcatattttttgccaaaccacacataacctgtagtaacaatgtacttttccctgctccaggatgcccaccaattaaaatcgcactacccggtacgatcccgccgcccagtaccctatctaattcactaaaaccactggaaaaacgtggtgtttcttgcaaactaatttcagagagcgtttgaatttttgcctgagtttcacccgcatagccactaaaacgatcattttttgattttgccgtggaaattaaccgcacttccgtaattgtattccacgctttacaagcggaacattgcccttgccaacgagaaaactccgcaccacaatcgttacatacataagctgtttttggggctttagccattttattctccgtatttgccgtggataacttcccgtgggtaagtatacccacggttaattatagttatagtggttcccctttggggaacatcaaactaccccaacggagtagcactgagatcagcctagggtatacctaccctaggtcataagataattccattaatttgatcattcgctcaaaataaactcgacttttcaaaagtgcggtcaatttttcaatagttttttcattgtctttcgtttcactatgaaaacgaatcaaatcacgaatttcaacaaagattttctgattgctttctaacaaagctggtaagcgcgtttctttttgtttttctgttgccatcgcttctaagattttcccattttcatcataataatgataaagattaaaaaatgccccgactcgctccactgttttcataaaatcttggctaaaaagtgtgggagaaaatgataaggtttcttccaaaagtttctgttccattttaagcaccgcattaaattttgcacaaaaatctaccgcactttcttctcgttcttcttttaagaaatcacgccatttattgagccaatctgttaaaaattgttttgagcccagcaaataancncgcttcgctttacttgcactactaaaataaatatctctttcgaaaggcaaagtttccacaaaatcaaaaagatcctgcacattgccagatttcaattcaaactcaatttcactgataggttgctcatattcgcctgcaataattttgccttgatcgaaagccacttcaattttagattgttgaaattcaactaaccaaaaagtgcggttaaaatctgtggagaaaataggttgtagtgtagagctaggtaattgttcaaaaggataaagccctcttaattgggcattagttggcgtttctttttcgattaatggtaaattatattctgggcgactatgcaatccactaacaactttaccgttagttttaagtgttaatgtaagttcttgatcttcttgacgaatacgcaaccccattttttgtttagcaagaaaatgatcgggataatcataataggtgttacccaaaaataaattttgatgttctaaaatcgtaaattttgcaagatattgtggcaattcaatacctatttgtggcgaaatcgccaattttaattcaatttcttgtaacataatattctccatttaaattaactggttaaatatacaatacaatagaaataaatcaagatttttgtggtgttttactttacatattaaatagctataaatgaatttttatttattgtgattaaaatattgcgacttttaaataaaaaaataatccgaaaaacataaacagatttcatcggataatattgataattttaaataacaaagccagattaaaatgtgaatatttactaatctaaattagcaataattgtgaaatgtcaattaaaataagtaagatgaaaatatgaatattttcatcttactcagcattttcaaaaattttatctttgttcggggtaaattacttcagatgtaacccatttcatccatacttgctctaataatgggattattgaggtactgtcttcaaccattgtattaagagcagacaaaacattttctaatgaatttggttgttcttgtagataacttaacaaccagtaatctaactctgaaaggatttgttgctgaatcctaaaatcactatcacgccatataatagcttgaattggcgtatcatcaaattgtttaaagtcacttgataaaaaatcaacgtcataactttttaaataagctgcaccagataattgcattacgctatgtctattccactcaaatttttcaggcactttggctaaagaaacttctgcgagtaattgtgtattttcaaaatccatcaatgccaatatatttgtatcaaatatctctttttcttgacaaaacaagagaaattctcctgcaatatcttggaaataaggagaatgggcattaccattttgcacaaaattttctttagcatttttccaatactctggctcaatatgcaatggtgcttcaacaaaacaacgatcaataaaaccaaaagcattattacgaactaaacgtgtatataccgctaaacggcttgcagcataaccatttaaaggatctgcattacctaaccgaatagcatttgccaatgcttgctgagtttctttcaatgatgacttaggcagcataagacattacctctgtgtgagcgtatttttgctgtaattgtgcaatatgctcaacttcggcgtaaagttctgcaaatggtgggaagttgaaatcacgctccaataatgttggaggaatcgtaggtagtcgttgataggcatattcgagtaaatcccatacagtgccttttacagcttctccgtgtgtatcaattaataattcaggtaaatggcgatatgctccttttactttattaaatgattcatttgctgaattctctacaacttgtgcagcagaatgttcttcatcgtgccctgcaatatgaatgtaattaacacgtttaacatcaacttgatctaaaaagatataaggatcaagtaatccgtgattaacaccattaacataaatattattcacatctaaatgaatgccacaatcagcctcttgtgcgatagcatttaaaaattccacttcattcattgtgctagtaggagaatgcaaataataagaagtattttctaatgaaatttgtaatcctaagaaatcttgcacatcacgtattcgttgcgcaacgtgttttactgcttcttctgtaaatggcataggtaataaatcatataaatgcccttcacattcacaataacttaaatgttcagaaaagaaagacgaattatattgattaattaatgctttcgtattacggagtaattcgcgatcaagtggtgcttgcccacctaaagaaagtgaaagaccgtgtactgctaacggaaatctttctgctgcttgatcaaattgataacgtgccattccacccattttactccaattttctggtgcgacttcaataaattgaatagcgttatttgagggaagttgtaaaaaatcctcagctaaattccgacgataacctagtccagcgccttgtaatttcataattaactcctttttaataaaagctggcataaattgttacgccagcataattattattcttatttagaaccgcatttaccttcgccacatttgccttcagcagatttagctttgtctgcaccgcatttgccttcaccacatttaccttctgcagatttagctttgtctgcaccgcatttgccttcaccacatttaccttctgcagcttttgttttgacacatttatcgcccacacaaggtgttgctgtattatcagtactgcttgactttgattcagcctgtgctgctgtcgctactgccatcgttaatgcacctgctaatgctgttaatgttgctaattttttcatttgaataatctcctagagtttgaattttgaataaataattagagaaatttcaaccagcttttagttggataaaccttcttaataagcgtgtctaaagagagtttccccgctccctgcgtaattaagattaataaagtcaccacataaattaatggtaatttataaccattatcacatacgttataacctgaatcggcgtgaatgctataccacgcgacagagattaaaatcgttaaacttaatgcactaaaacgtgttagcaccccaaatatcagcaagaatgggaaaattaattctgatcccattgcaacgtgccaattaatatcggcaggaataagattaaatggaaaaggaaaacgatcttgtatttcagcgaaccaattttgtccattccatttttctaatcctgattcaaaaaactcccatgcgagaaaaaagcgtaaaatcaataaacttacgccactgccgataccttgcatcttacaatccttcatttttttacctttcaaattttctcgcttttaaagcgaaaagtgtattgagttacttatcttaccacactaggaaatattacccagttgcttacttagtcgaagataaaccttttttcttacaaatttttttgaaaaattttaactatcaacaaaaatcgggtaatatgcgcacgaatttttaaccccttaatttggagtaaatcacttatggcaatgaataatattctcggattatttgcccattcgcctctcaaaccgttacaaaaacactctgaaaaagtgaccgaatgtagcgatcttttgattcctttttttcaaactactttctcaaagaattgggaacaagcggaagaaaaacgcttagaaatttctcaatgtgaacgcgaagcagatagtttaaaacgtgaaattcgattgaaattgccacgtggtttattcttacctatcgatcgtactgatcttttagaattagtcacgcaacaagataaacttgccaattatgccaaagatattgcaggccgtatgattggtcgtcaatttggtattcctgaagaaatgcaagaagaattcttacattacgtaaaacgaagtttagatgctattcatcaagctcaccgagtaatagaagaaatggataagctattagaaacgggttttaaaggtcgtgaactcaaattagtcaatgatatgattcaagaacttgattcaattgaagatgatacagaccaaatgcagatcaaattgcgtaaaatgctttacaccatcgaaagtcgttataatccaattgatgtaatgttcttatataaaattattgaatgggttggcgttttggctgaccaagcacaacgtgtcggttcgcgcattgaattaatgctcgcgcgttcataatcaacaaaacataggaaataaactatggaaattattagtcaatatggttcttggttggtgtggatcacagcagtctttggcttttttatggcgttcggaattggagcgaatgatgtctcaaattcaatgggaacatcagtaggatctggtaccataaccgccaaacaagcgattattatcgcattaatttttgaatctgctggtgcctatctagcaggtggtgaagtaacacaaaccattaaaagtggtgtaatcgaaccaatacaatttgtcgatacgccagatattttagctctaggtatgctttcaaccttatttgcatcgggtgcttggttatttattgcaaccaaaatgggttggccagtttctggtacacacactattattggtgcaattattggatttgcctgtattacgattggccctagttctgtagattggtcaaagattggcagcatcgttggtagctggtttgtcacgcctgtcattgcgggtattttggcttatgcaatctttgcaagtacgcaaaaacttatttttgataccgaacaaccactaaaaaatgcacaaaaatatggcccttattatatggggataaccgtgtttgtactttgtatcgtgacgatgaaaaaaggcttaaaacacgtaggcttaaatctttcaaacagtgaaactttaatcatttcacttgccatcagtcttatcggaatgtttttcttccatttctattttaaaagcaaaatcttcactcaatcagcaaacaaaggcacttttggtgcagtagaaaaagtcttcagtattttaatgttattaaccgcttgtgcgatggcatttgcgcacggttctaatgacgtagccaatgcaattggccctctttctgcagtggtctctattgtaaatgaaggcggtaaaattgtttcaggtggagccttaacttggtggattttacccttaggtgcattaggtattgctgtgggcttaattactatgggacaaaaagtgatggcgactgttggatctgggatcaccgatttaacgccaagccgtggctttgccgctcaatttgctactgcgatgaccgttgtcgtggcatcaggcacaggcttacccatctcaacaacacaaacacttgttggagctattttaggtatcggctttgcacgtggtatcgcagcactgaatttaacggttatccgaaacatcattagttcttggattgtcacattaccagcaggtgcatttttcgccattattattttctatgtgctaagaacaatctttaattaattgatctcaataaaaagtgcggttaattttaaccgcacttttgttgtgatgtttaaggggaaaaaatgaaaaagatctataaagccttaatctcatctttacttttaagcacatcaataaatgttgcttatgcggaaacccaatatgttactgaaaatttaagtactttcttacgtcgtggtgcaggcgaacaatttaaaattgcaggttcaattcaagcaggcgaagcggtgaatgtattagatcgccaaggcaaatacacactcattcgcgacaataaaaatcgtgaagcttggattttaaattcagacttaagcagtacgccaagtagtaaagaagaaaatccaaaattaaaagcgcaagtacaagaattaaccttaaaacttagtcgtttagatggcgattggcagcaacgtaccgtagaaatgcaacgtcgaaccaaacaagctgagcaacaaagtgcggttcttttagagcaaaattcacaattgaaacgtgaacttgaaatgaccaaaaataaaaatcgtgatttagaagcgatacttgatgcaggtaaacgagaaattgcgatccaatggtttatttatggcggttcagtattgggcgtaggcttactcttcggcttgctcattccttatgtgttaccaaaacgtcgccgtcgtgatggctgggcataatcacgaatgaaagtttatttggttggaggggctgttcgtgatcaattattggggttacccgtaaaagatcgtgattggattgtggtaggcgcagaccccgctacgctactctctctcggttatcagcaagtaggcaaagattttccagtttttctcaatcctaaaacaaaagaagaatatgcgcttgcccgaacagaacgtaaatctagcgcaggttacacgggctttatttgtgatttctccccaacaatcacattagaacaagatttaattcgacgagatctcactattaacgccatggctcaaagcgaagacggtgaaattatcgawccttatggtggaaaacaagatttagaaaatcgaattttgcgccatatttctcccgctttttcagaagatcctttacgagtattgcgcgtggcacgctttgctgcccgttatcattccctcggttttaaaatcgcctcggaaacattagctctaatggcagnacttgcccaatcaggagaattacaacatctcacggcggaacgcatttggctagaaacagaaaaagccttaaacgaaaaaaatcctgaaatttattttgaaaccttacataaaacaggcgcattaagcgttttattttctgaaatcgatgccctttatggcgtaccaaatccagtaaaacatcatcccgaagtggatagttttattcataccatgttggtattaaaacaagcggttaatttgactgaaaataaccctatcctaaataaaagtgcggttcgttttgccgcaatttgtcacgatcttggcaaggctcttacacctcaaaatattcttcctcatcattatgggcatgaacaagctggcataaaaccgactagatcattgtgcaaacgcttgaaggttccaagttattttcaagaacttgcagaactgacttgtgaatttcacacgcatattcacaaagcctttgagcttcgagctgaaaccgtcataacgctgtttaatcgttttgatgtgtggagaaaaccacaacgctttcaagaatttctacaagtatgtctcgctgatactcgaggtagaacaggttttgaaactaaagactatccacaaatagattacatcaatcaattattacatgcggcaaatgaagtagatgtacagcaagttattgccgatggatttgagaaacaagcaatcaaaaatgaattgacgaaacgaagaatcttagcggttaaacaaacaaaaacgaattacccaacaaattaacaaataaaagtaactttactcaattaaactaaatccttaaaatatgcgagcttattaacttgatgaataatatgaaaacctttaaatttttcaccgcacttttkgccactgcgattctaaccgcttgcacattagatatggaacgtcctactaatgtacaatacattgataaaacggatgcgatatggcaacaacatttacaaaagattcaaaaaattcaatcctatcaagccaaaggacaaattggttatatcagtccaacagaacgtttttctagccgctttgaatggcaatatcaaaatcctaaatcttatacgcttaaactctattctttaatcagtaaatcgactctttggattcaaatgcatcaaagtgggatgacaatttccgataacaacggcaatcaacaatctgcagccaactccaaactattattacaagagattattggcatggntgtgccattagaacatttagcttattggttgaaaggccaaccagcaatgaacgcggattatcaagttggcaccaaccatttacttggcgcatttacttatcatgtggatggttctcaatggacggcagattatctaacctatcactcaaataattcgatgcctgaaaatattttgctgaaaaatgacagcacaaaacaaaccttaaaaattcgcgtagacgagtggatttactaatgaatacattaatgaaatcacatcaattttctaccgcactttgccaaaatacaacagaatcaaatgggcagccattacgcttccctagcccagccaaactgaatttatttctttatatcaatggaaaatttccgaacggctatcatgaattacaaacgcttttccaatttttagattttggcgattggttagacattagtattcgggaacaagataatcaaattgttttaacgccagaaattccaaatctaaaaacggaaaataatctaatttatcgagccgcaaaacttttacaagaaaaagccaatattcaattgggtgcaaatattcatttagataaaattcttccaatgggaggcggtgttggtggtggttcatccaatgcagcaaccgcattagtctctttaaattatttatggcaagccaatttatccattgatgaactagcaaaattgggattaacattaggcgcagatgtgccaatatttgtacatggacacgcagcttttgctgaaggcgtcggggaaaaaatcacttattgtgaacctgccgaaaaatggtttgttatattaaaacccgatgattcaatatcgacggctgtgatatttcaagatccaaatttaccacgtaatacaccgaaaaaatccctcgcacaacttttgagtgaaccttataaaaacgattgcgaaaaagttgtgataaatcattattcaaacgttgaaaaagcgttaaactggttgctacaatatgcgccggcaagattaacaggaacgggagcctgtgtttttgctgaatttgatcatgaagcagaagcgcaagsggtatttagacaaaaaccagaagcattttttggtttcgtcgctaaaggactcaatgtgtctcccttgcacgcaatgttgaagcagctatcatcaactcatactcatagacaatctaaacctgaggttttataaaatgcctgacattaaactcttcgcgggtaatgctacacctgaacttgcaaaacgtatttctgaacgtttatatatttcactaggcgatgcaacagtcgctcgtttcagcgatggagaaattcaagttcaaattaatgaaaatgtgcgtggtgcggatgtatttatcatccaatcaacttgtgcgcsaaccaatgataacttgatggaattggttgtgatggtagatgcgttacgtcgcgcatctsctggtcgtattactgccgtgattccttatttcggctatgctcgccaagatcgtcgtgttcgttctgctcgtgtgcctattaccgctaaagttgtggcagatttactttcaattgttggtattgaccgtgtcttaacctgtgacctacacgcagaacaaatccaaggtttctttgatgttcccgtagacaacgtatttggttcgccagttttaattcacgatattttgaaaaaatctgatcttaaaaatccaattgttgtttccccagatattggcggcgttgtacgtgctcgcgctgtcgctaaattattaaatgatacggatatggctattattgacaaacgtcgtccacgtgcaaacgtagcacaagtgatgcatattatcggtgatgttgcagatcgtgattgtattttggttgatgatatgattgatactggcggtacgytttgtaaagcggcagaagcattaaaagaacgtggtgcaaaacgtgtttttgcttatgcaactcacgccgttttctctggtgcagcagccaaaaatttagccagcgatgccattgatgaagttgtagttactgacacgattcctctatcagaagaaatgaaagcgatcggtaaagttcgcgtgcttacgctttcttccatgctggcagaagctattcgccgcattagcaacgaagaatctatttctgcgatgtttaactaaattaaaatttcaataaaaaataccgcacttttattgccaaagtgcggtatttttttatttactttatttaactgtatctactttattcaaccgtacacgcgcaaattttcgtttacccacttggtaaacatttgtacctttcggtgcattgtcttttacgttatcgactttttcaccattgatttttacaccgccttgttgagcagagcgaatcgcttcagaagtggaaggaacaagacctgcttcttttaataaggtggctaaacccatttcgccagagaacgtaaattcaggcatttcatcaggcattgcgcctttttggaaacggttaataaattcttgttctgcagcgtttgctgcctcttcattgtggaaacgtgcaattaattcttttgctagtaagattttgacatcacgaggatttttgccgttttctacttccgattttaattgtgcaatttcgtttaatggacggaatgaaagaaggttataccaatcccacatgagttcatcagaaattgacatcactttaccgaacatatcgcttggtgcttccgttacgccaatatagttaccaagtgatttagacatttttttctcgccatctaagccaacgagtaatgggagtgtaatcgcaacctgtggttttttgcctgctgatttttgtaattcacgaccaacaagtaagttgaatttttggtctgtaccgcctagttccacatctgcgtctaatgcaacggaatcgtagccttgtagtaatggataaataaattcatggatggcaatgggttggttgtttccaaagcgtkttttgaagtcgtcgcgttcaagcatacgcgcaaccgyatagttgcttgcaaggcgaatcatacctyctgtaccaagtttgcttaaccattcagagttgaagacgattttggttttttgtggatcgagaattttataaatttgctctttataggtttccgcattgcgcaatacatcttcacggctaagtggaggacgagtcgcatttttgcccgatggatcgcccaccattccagtaaaatcgccaattaagaaatagacttcatgaccgagttgttgaaattgacgtaatttgtttaatacaacagtatgtcctaaatgaatatctggtgcggttggntctgcgcctaattttacttttaatgggcgattttctttcagtttttcgattaaatccgcttctgaaaggatttcatcagtaccacgctttagttccgcgagaacggtattaatgtcagtcattattattncctaaattatgttttaaaaggttttattatagggattcttagcaatttgtgaataaaaaaaaacgcctatctgtggggaaataggcgggaatgttggagtgattatctaatattgttgttggaatgattagatgataattgttatcaatagccttgtcaatagttaaatgaaaataattcctcaaaaaaataattnattttatataagacaccgattctgtcaaagaaagtgcggtaggaatttcattagaaatttcaaattgtcccgcataagcataggcttcaacaccttgttccattgcttcttttaataagcgatcatattcaggancgatatattccgcaattttgaaacgatcaaacccattatgtaacccagcaaatagtaccactgctcgatgaccttgttttttcattgccaataactctcgaacatgtttttgcccccttgtagtaaccgcatcgggggacatacctaaattgccttttacaagcgtgattgatttcacttctacataacaatcaagcaagccttcgccttttagtaagaaatcaattcggctattttcctcgccgtatttcacttcagggtaaatttcatcatacattgccaattctttgatttgcttattttgcaatgcttcaaagacaagctgattagaacgatgcgtattgatacagcaaagctgtccatttgcgagttgagtgagttcccaagaatggggatatttacgagtttgactatcagaatgtgaataccaaattttatcgcctttttcaccgcatccagtcatcgcacctgtattggcacaatgaattgtcataacatcaccagttggcaattcaatatccgcaagaaatcgtttgtaacgacgaattaatgtcgccgattgtaaagctggaagttgcataaagttccttatttaagtttttctaaacgttgtaaaatagcgttgtcgttcatagcttgcatttttttcattctcaaagaaagtaagaatgccgcaaaagtgagcgagaccacaaaggcaatccagaaacctttcgcatcaatgtgtggcacaagccaatctgtacgacctagcgtataaccaagtggcacaccaattacccaataagagaaaagggtaatgtataaaatgactttagtatctttataaccacgtaaaataccaccaaccaccatttgaatggtatctgaaaattgataaagtgcggcaaataataatagatttgctgccatggcgatgacaatttcatctgtcacgaagatcgatgcaatttcataacggaaaaaaatcgtaattaatgcagtaacaattgtcacagttagccctaataataatgcggcatagccaattttcttcgcattttgtggagaacctgcacccaatgcttgtccaactaaaatcgtcgttgccataccaatcgacatagggaacataaaaataaaagaactagtattcagcgtaatttgatggcttgccacaatagttgcacccagcggagaaagcattaaggacgtaagtgcatataacgccacttcgcaacaaattgcaatggcaatgggtaatcctaaacgcagtaattttttaagtgttttcggatttggcatttcaattaattgactaaatacttttagtgaacgttcttgagtattcgtgtaggaatagaaaatcatcattaagcacattgcccagttcacaatagctgtcgcaataccacagcccaccgcaccaaaagcaggcataccaaattttccataaataaaaatgtaattaagcggaatattaatcaataaacctaaaaaggtaatgaccatcgcaggcttggttttctcaatcccatcatttaaacaacgaaaattaatcagcatcaaataagctggcaatccccacaacatcgcgtgtaaataatcgcgtgctaaatctgacattttgctttccatttgcatatattgcagcggaatttcacagaaataaatcagtaaacctaaaggaatactcacgcctaacacaagccaaatgccttggcgaacttgatgtgcaatgcgatggtgttggcctgaaccattcaaataagaaattgtaggcggcaatgccaacaataaaccttgcccaaaaaacatcaatggcatccaaattgaagcaccaatagaaatggctgccatatcagtggaactcactcgccccgccataatggtatccgctaatcccattgagttttgtgcgatttgtgctaataaaataggcaaggaaattttaatcaactttttaatatcagcgtggtattgagataaaagacgaaaattcataaatttgatatactgctaaaaatttttagaaaaggaaaaaattatgtttactggaattgtacaaggcaccgcccccatccactccattaaagaaaaggctaattttagaacacaagtggtaaaattactacctgaaatgcgtaaagatctggaaattggcgcatcaatagcaaataacggcgtatgtttaactgtaactgaaatcaatggtgatctggttagctttgatctgatgcaagaaactttaaaaattacaaatctcggcacagtaaaagtgggcgattatgtgaatatagaacgtgctatgcaaatgggaacggaaattggcggacatttattatctggtcatatttattgcaccgcaaaaatttcagatattatcgctagtgaaaataaccgacaaatttggtttgaactgccaagtgcggatgtgatgaaatatattttaacgaaaggatttgttgcggtagatggcattagcctcactattggcgaagtaagagacactcaattctgtgtaaatttaatccctgaaactttacaacgaaccttaatggggcggcgtaaagtgggcgatattgtgaatatcgaaattgatccacaaacgcaagctattgtagatacggtagaaaattatttgcagtcaaaaaatttctagttcatttaaaaatattaagcaattgaataaagtgagaatgggcataaagcctattctcacatcatcaagtgttactgcaacgctttctcaattttttcaaataaatcttttgaaagattttctacaacgcttaggcgttctaaagcacgtttcatcagcgtttggcgttgggcatcaaagcgagaaaaacgaattaatggctcgattaaacgcgcagccacttgcggattactttcatttaaacggattaacacatccgttaagaaacgatagcctgatccacttacattatggaatgcttttaagttgtgatttgcaaagctacctactaatgaacgtaaacggtttggattattaaaattaaaacttgggtgatccattaataactgaataatttccaacacattatcatctgggcgagtggcttgtaatgcaaaccatttatccatgactaatccatcgtgttgccatttttgttcaaaatcagctaataacacatctctgcaaagtaatgcagctttagttgcaacacttaatgccgccaatgtatctgtcatattattcgcattattgtagtgtttttgcactaggttattgcccaaattggtgtaagccaaataagttaaacaaagattacgcattacacgtaaggcgatgtcttgttgcgtaacttgataatcattaagacgaatatgggtataaacacgcaagaaatcatcttttaaagattctgcaatttgagcttgcataaatgctcttgcggctgaaataccatcaggatcgatggttttaaaactttctgcaaactccatttctttcggcagtgtgagaattaaggttgccaattcaatatctttctcataatggttcagracataagaaagtgcggtcaaaatttcaggcgaaatttctaaagcctcgccttgttggaaacgcacaacattacgacgcaattcttgcgcaaataacatttgagccgcatcccaacggataaattgattatctgcaaatttaagcaagcctaataactgctccgttttataatcataatccagttttactggcgcagaaaaatcacatagcaatgcgggaattgggcgaccataaatgccatgaaactcaaagacttggtctttttcagtgacatttaatacatcactcaacaattcgccattatgttgtagcatttgtttcgtgccgttcgcatcataaagcgccacttttaatggaatatgtaaattcactttttccatttgatctgcggttggcggtgtggattgtgaaaccgttaaacgataagtatgcgttttttcgtcataagcatcactaatcaataattctggggtacccgattggctataccaacggcggaattgatttaaatcgaggttatttgcacgttccatcgcagaaacaaagtcttcacaggttgccgctttgccatcgttttcagcaatataaagttgcatgcctttttggaaaccttgttcacctaataaggtgtgcaacatacgaatgacttctgcccctttttcatatactgtcaccgtgtaaaagttattcatttcaatcactttttcagggcgaattgggtgcgacattgggcttgcatcttcggcaaattgcacggtgcgtaaaaatttcacattattaatgcgattcacggcacgcgaacctgtatctgaagaaaattcttgatcacggaaaaccgttaaaccctctttcaaacttaattggaaccaatctcggcaggttacacggtttcctgtccagttatgaaaatattcgtgagcaatcacactttcaatggcaagataatcatcatcggttgccgtttgtggatttgccaacacaaatttggaattaaagatatttaaccctttattttccattgcgcccatattgaagaaatcgacggcaacgatcatataaatatctaggtcatattctaaattaaagcgatcttcatcccatttcatcgcttttttcagactttccattgcccaagttgcacggttaagattaccgcgatccacataaagctctaaagccacttcacgaccacttttagtaataaatttatcttgtaataaatcaaaatctcccgccactaaagcaaataaatagcttggttttgggaaaggatcattccattccacccaatggcgaccatcttctaattcgccacttgcaatgcgattaccattcgacagtaagaatggatatttggttttatctgccgtaattttggttatataacgcgccagcacatcaggacgatcaagcatataagtgatttgacggaaaccttccgcctcacattgcgtacaaataccctcgccagactgatatagcccttgtaatgacgtattttcggctggcacaaggaacgtcacaatttcaatctcaaattcatccgcacttttgtcttttaaatcgagcgttaaactctcgccatcttgttgataatcagaaaatggctcgccattaaatttaatagaagaaaactggaagctatgcccgtctaaacataaagaagtcgcttcattatttaagcgttggaattttgtgattgcggttaccacagtatgtttaggatcaagttgaaaatctaaataaatatctgtgaccgtaaaatctggttgtttgtaatcttttctatattttgctttggctaacataatttgacctattcttataaaaattgtgcttaggataaaattttatccttaaagttgcaatggtattttcctataaaagccatttagcaaacgtttgcctgatatatgtaagatgtgctattctacgccacgtttttaattagaaaattgagaaaatagcatgtcaaaaactgcacaaattgccgttgtaatgggttccaaaagcgattgggctactatgcaagaggcaactcagattttagatgaattaaacgtgccttatcatgtggaagtcgtctcggctcatcgtacgcctgataaactttttgaatttgcctgaaaatgcacaaaaaaatggctataaagtaattattgctggtgcagggggggcggcacatttacccggtatgatcgcagcgaaaacacttgtgccagtgctgggggtgccagtaaaaagttctatgttaagtggtgtggatagcctttattcaattgtgcaaatgccaaaagggattcctgtcggaacattagcgattggccctgcgggtgcggcaaatgctgggttgttagcagcccaaattctagcaggttgggatgatgcgttattcactcgcctacaagcattccgcgaaaatcaaaccaatatggtattggacaatcctgatccacgcacataaaaacatctttagatctgaccgcacttttaaagtgcggttgtttttttcgtaaatttaacgagaaatattatgcaaaactccaccttatacccaacggtttatgtactcggcaacggacaactcggcagaatgttacgttacgctggtgcacctttagatatttatgttgaacccttagccttcaatgcaccagtttttgacttacctgaaaatgcgatcatcacggcggaaattgaacgctgggaaaaaacgcctttgactgaattactcggcaatcataaaaacttcgtcaatcaacatatatttggattattggcagatcgttttactcaaaaatccttacttgatgaactgaatctttctacctcgccttggtgtttattaaaagataaaaatcaatggaatgatcttttccaaactgttggcgagaaagtcgtcgttaaacgtagaacaggtggatatgatggacgaggtcaatggattatcagagatgaaaatagagcggacatcaccgatgatttatttggtgaagtgatcgcagaaaaatttattcctttcgattatgaagtatctattgtaggcgcaaggtttaaaaatggcgaaaagcgtttttatcccgttacacataacctgcaacaaaacggtattttgcgttacagtgtggttgattgtgcttttcctcaacaatccgtacaacaaaagcaagcagaaacaatgctcggcaaaattatggataaattaggctatgtgggtgtgatggcaatggaatgttttgttgtaggcgacaaattactgattaacgaacttgcgcctcgtgtacataacagtggacattggacacaactaggatgctcgattagccaatttgaattacatttacgtgcgctactcaatttgccaacgcctgaattacaaacattcgccccaagtgtaatgattaatttaatcggcaccaatcataaccctaagtggcttaacataccttttgcacaacttcattggtacggtaaagaagtgagaattggacgtaaagttgggcatatcaatctttcccatcctaataaagcggtcattattcaacaattagaaaagctttgcactgaattaccagaagattatcaatcaggattaaattgggcgattgaaaaactaaaataatgtaaaaaatgaccgcactttttgatgaatatttaaaaatatcaaagcgtggttaatttttataaaatctttcttgataaaataaaatgactgaagtataaaactattcatcacacaacacatacataaggaaaagctatgtttgaacatatcaaagcggcaccagccgatccaatcttaggcttaggcgaagcatttaaatccgaaactcgcgaaaataaaatcaatttgggtattggcgtttataaagatgcgcaaggcacaaccccaattatgcacgcggtaaaagaagccgaaaaacgattatttgataaggaaaaaaccaagaattatctgactatcgatggtattgcggattataacgaacaaacaaaagcactccttttcggtaaagattctgaagtcatccaatctaatcgagcaagaacagtacaaagtttaggcggaacaggtgcattacgcattgcggcagaatttattaaacgccaaactaaagcacaaaatgtttggwtcagcacaccaacttggccaaaccacaatgcgattttcaatgctgtcggtatgaccattcgtgaatatcgttattatgatgctgaacgcaaagcccttgattgggaacacttattagaagatttaagccaagcaagcgaaggcgatgtggtgcttttacacggttgttgccataatccgactggtattgaccctactccagaacaatggcaagaattagccgcactttcagctaaaaatggttggttgccactctttgactttgcttatcaaggtttagccaacggattagatgaagatgcttatggtttacgtgcttttgcagcaaaccacaaagaattattagtggcgagttcattctcgaaaaactttggtttatataatgaacgtgttggtgcatttacccttgtggcagaaaatgcagaaattgcatcaacctcattaacccaagtaaaatcaattattcgcaccctatactctaacccagcttctcacggcggggcgaccgtagcaacagtattaaatgatgctcaacttcgccaagaatgggaaaatgaattaactgaaatgcgtgaacgcatcaaaaaaatgcgtcacttattcgttcagttattaaaagaatatggtgcagaacaagatttcagctttatcattgaacaaaacggtatgttttctttcagtggattaacaggggaacaagtggatcgtttaaaaaatgaatttgccatttacgctgttcgttctggtcgtatcaacgtagctggaatcacagaagataatattcgctatctatgtgaaagtatcgtgaaagtactttaattagagttagaaatcatctctaacctaaaatagagcaaatataaatagttaaagccttgattatcaaggctttaattttatctaatcattaacaaattctcggcaatggttcatttgttggtaaatctaacaatcgactttgtccaaaaatgcctactaaacgcacttttttatcggttattacttcaccaatcacagccgcatttttacctaatggatatagaaatcataaactgataatttctgtggctaattcgttaataaatccatgatgatgggatgaaatcaaaatgggtaaggaaagttctcgcaaaagtgcggtcaatttttcagtattttttcgatctaatccattggtgggttcatctaataataagatttttggctgcatcgctaagacacctgcaagtgcggtaaaatttttctcaccaccagataaggtatgtaccatacgatcttttaaacgtgtgataccaagacgttctaattgctgctctgcgatatgatacgcctgctctctaggcacattttggtttaatggcccgaaggcaatatcatccaatactgttgggccaaaaagttgatcatccgcattttgaaaacaaatgccaatcgtgccacgaaatggcgcaaaatctttttctttacgacaaactttgccaaatagtttaatttcccctttggttacaggaacaaatcccaacaaagcaagcagtaaagtggtttttcctgaaccaatttccccttgtacgaaaaggcgtttttgaccttccaaggtaaaactcaaatcttgaataatcgctctaccattgcgttctatacaaagattatttacagctaacatgttatttttctctctttttgccgaactgaaaaccacgacattttaacgccatttgcgccgtttcagctttcagcagggcatgaatcaataataaagcgacactttgagcagtcacataaagagttcggcgattaagccgaggacgaaatccacgagcgcgcatggcaatatccattttttgacgcaattctccaagcagtgcaatgtaacgtacggtcagcacaaaaagttgaattaatttttctggcaaaggcaatttgccaatggcttggaacaagcaccgcatcattaatattccataaaaaaagccaaagagaaatcagcaataaatgagtccgtaaactcaatttttctgctaattctataccttgaaaattgagttcaatgccattttctccaattttccaacttaatgtcgcccacattaaaacaatgaaaatgactaaagcaaaccaacgtttaagataaggcaaaaaagatttttgactgnactgcagtgaaataaaaaagagagaaacagnaagcacattaagggggataagccaagtgagatcacttaatccactaatgattagcccccagataaacagataaatcaacctaaagtgcggttgaaataagtgatgaattttcattaagagaaattctcggtacgattcatcacttcaggatacattttaccaagcaaggtaatcacccctacgctgataatactatccaaaataaataccggaatatgagagactagcaagagccaaacaagattcagataactttttccaccatctaacatcagcacaaaagaagcaagcgcgcctgccccgccaacgccaattacgccagctccaataccaactaataagcgatcttttaatgccatttgtggctgtaaacgagaacggaaaagataatgagcgatcaccgctggcgttgccatcacacaaagattgacgcctaacacggcaaatccaccaaaagaaaagaaaatgacttgcaataaaagtgcgatgaggaatgctggaaaaacagcccacccaagaaataaaccagccatgccatttaaaattaaatgcacgctaccaattcctacaggcacatgaatggttcctgccacaaaaaatgcagcggcaaaaagtgcggtgagcggtaaacgttctgattctaaacgacgtaaccccacagcaatgcccgcaacagcaagcactgcaccagctaataaaataggcgtatgtaacacgccttcagataaatgcattaaatacgtccttgtttaattttacgcgcattacgtaaagcaataagtccagcaataccaacgatataaccgattccgcctaaaatatcatgcaaataaattttatcttttaaatgtgcaatatcttcacgaagcagcattaaatctgcaccgctttgattttctgcagatgtatgagcggcaacaacggacgcacggtgtccttcatcgccttccaccaccacttttaaggttgtgtgtggcacatcagcaatagaaagcttaaatacaccttggcggtctgtttttccagttaaaacgggatcagaaacacctgagcggaaaacttctaaataagtttcagctgctggggtcatatcagaataataggatttgccagagagtgtttgcccatcatattgggcaaacacataaagtgcgtgggcataagcattcgggagatagcaagccgcaaaaagtgcggttaaaaaagcaaattttttcatcccaaatccatattattgtgcgtcaaaagttagcatatattccacagttcgacgatcgtaatccgcattatttgttactttttcctcaaactctgcccatactttgttgaagcctttagttggcgtaaattgagcgatacctttttcattagttaaattgaacggtgcatcttcactcacacccactttaatgccttgaacgggtttaccattatgtaacacaaggatagaaagtggtttattcgcttgtgctttttcttgaggaatcaattcgtaagcttgttgatgagatttgaaagattcagcatcccatttcaaaatcgctttaccaaatttaacaggattggtactaaattctgctgttggttcttcacgttttgttttttcaacgtatttaccgcttggtaattttgaccatacaccattatcgaaatgaacgaatactaaatctgatttaggcataagataggcttcgccatttctgaattggtaatcaacggcagttaatttgccttgcgaatttaaggcttggatagatttaagtttagattctggataggtttcagtttgttcatgtccaaatttcaccacgtattcatcttgcgatgaagcaggctcaagccaaacattgtgtgcgttagcaacagacatacctaaaagtgcggttaatcccacagcgatttttttcaattccattttggatactccttgtttgtttaagaaaatctaggcgtatgataaaatatgaagtaactttagaatcaagtcattttttaaggaaattgatgaaaattggagcacttgctaaagccctaggctgtaccgtagaaaccatccgttattatgaacaacaaggtttaatcccgcccccaaaacgcacttcaggcaattttcggcaatataatgaagaacatttgcaacgtttatcatttatttgtaactgccgaaatttagatatttcattaagtgaaataaaaagcctactgaatttggaaaatgcctccaaacaacaagcagaagaaattaatcgtgtgttagataaacacattaaagaggtggcaacaaggattcacgnactcgcccatttacggatgaaattaattgaattacgtgaaaaaacagtctcgaatgatgaagatccaatgaaattgctattgcaacatagtggcgtaaaatttgtgcgattaaaataaccgcacttttagattatggctgactagataaacgctgttttgcttccttattgcctaattcagcggctttcttcagccattccaatgattttttcaggttggttttgtaagcgataaatattacttaacatcatcatcgcatctgtatctttagcttgcgctgtacgttcaaaaagcttaatggcttgctctgtattttgtttgacgtaatcgccacgtagatacataacgccaaggttatttagccctttcacactgcccttctctgccgcttcgctaaaccaccaataagccttttcatagtctctcaccgtgccacgcccaaggttatataacatacctagattgctttgagccgttatatttccttctaacgccattggatacataatattgaaaacgtcgatccattgttgtttattggcaaactcttgtgccaaattcattcttgcttgatcatccattttcggactcgctgtaacatcaacggttttcattgcccaaataggcaaactaaaacaaagtaatactatatgaaaaaataacttcagtttcatttacaaggttgctactaaaagtaaaataaaaaacacggcagtaatcgcaaattcgattagtccaacttgcataacagaaagctttttagtgggcaaataaacggctcgcactaatccaggcacaaaagctaatgctaaaataaattgttgcgaaaccacaaaaatcagcgcacataataagtgaaaaatcactgatgcccaaaaataacgtggattttttcgttcacgcatcattgattttacataaagtgttgttccaataaaaaataatgttggataaatcgccacccaaagtattttttcatcaaaagttcggtcagaaaagtaataggatcccattccagctagagcaaaaattaagatccctgccaagtcattccataaattgcgctcatcttttttcttggtgaaataaatattcaccgcaacaaacggtaacatggcaaacataaaatacaacacttgccaattataaattaacgcgggaatcgcaaaaatcactgcggcagcaaaataaatcacagaccattttttatataactcaagatttttacctttaaacaaattcaaaaaaggataagtcatcaaataaagcgaaaaccatcctaataataaaaagatgtgcgcccatacaggattcgcaagtaacatgccgtaaataaaaggcaccaatgccataacaatagcaccgtactgattagaaataagcagtttcataataattaaataattgagaataattgtcgggtattttagcctagtaaagaggattttacaaagcagtaaaggctatttagaatagaagaaaacaccccaaaggagaaccctatgacaattcaacgcattttacccagtgcacgtttaagtgaagtttcaattcataacaacctcgcctattttgcagggcaagttccagaattaaccatcgagcaaaatgcctacgaacaaaccaaagaagtattaggtttaattgataaattgttagcaaaaattggctccaataaaagcaacattttaactgcgcaaattttcttagctgatatgaaagattatgcacaattaaatcaagcttgggatgaatgggtcgatcatgttagcccaccaagtcgagcgacagtggaagctaaattagcggatcctcattggaaagttgaaattgttattattgcaacttgttagttttttaagccgaataaacaggagaatattatggaaaattggaccaatgaaatttgggtagcaattggcatcgcttttattgttggattatttattggttacattattgtgcgtttaaccaaaggatccgtaaaacatcaagctaaaacagaagctgaattaaaaacagtcaaaacccaacttgatacacaaaaggcgcaaatcgaaaaacatttcgcagaaagtgctgagttattcaaaaccttaattaacgattatcaaaaactttatcgccactacgcaacctcttccaataacttactgggcgaaaaagatcaaaaaggtttatttacccaacagttaattactgcaacagataaatctcaaaatgaacagcctagagattattcggagggtgcatcaggcttatttaaagaaaataaagaagaaaattaaaaagtayggctaaaaatagaaatatttttagccgtttattattctattattgcgttgattttttagattttttccatttccaaaaaagaatagtacaagtacccaataaatatataaatcacaatttgacctttttgaatttgtgtatgtagccaatctaaatttttagcccccaattccccaagataaatccaaataggtacagaaataatcgcagcacagaaatctattaaaacaaaacgaacataacttacacggcgtgtaatacctgataccatataaattggagcacgtaaaccgggtaaaaatcgtgcaacaaacagtactcgattgccatattgactgaatttttcacgcaccattcttaaacgctgtaatgttacgattctacgtattggtcggaaacgtaaaattttcgtgccataaattcgaccaagccaatacatacaggaatcgccagcaagcacaccaatcatactaaccagtaacatcaaatgagaattgacattttctggataaagccccgcaatgacaccacctgaaactaatgttatatcttctggaataggtacaccaaatccacaaataattaaaacaaaaagracagcccaataaccatattcagtaaaaaatccaattaaaaattccatttgttcctgcttttttattatattaatagatgtgataaaaaattggttcacattttaatcttttcaaatcaaaaagcctagaaaaaagtttgatttgaaaataaggatattctataatccacggctctcaaggcttgtcyttgarcggtttttaggaaaattgckgggycgcctgcgatttyctttcttttaacattaatttaaagagaacattaaaatggcatttaaatttaacgctgaagttcgtacagcgcaaggtaagggtgcgagccgccgcctgcgtcacaatggtcaaattcctgcaatcgtttatggtggtagcgaagagccagtttcaatcatcttaaaccacgatgaattaaacaacgnacaagcacacgaatctttctattctgaagtgatcactttagtagtagagggtaaagaagttgcagttaaagtacaagctatgcaacgccatccattcaaaccaaaattggttcacattgacttcaaacgcgcataattctaattcacgcatttaaataaaataacaaaaaagctaagacattcatcttagcttttttcttacagattcattgtttctcaataaatatctaaacttcaattttttatcaaataacgttttaagttttcaccaacaaattctaattctgcttttccatagtttggctgaaattctaaaaaaatcaccccagcctttcgacaagcctcccgtttcactgcatcacgcttcgccgcattatcctgataatgtccctgcccttgatattcaattactattacggcatagccgttcttatctacaatcaaaaaatctactcgtttactatttatcgcaaaatgggcctctttatctattgattctaaaaactcccccattgaaacctgagtaaataaacggaactcttgataacctttagacaacaacttttctaaacgaagaaaaagttgatattcactcttattcattaaggcttttcttttatacttactcaatatgacgacatcaagatgatcatttttattcacaatattaattttgttttctgtcgaaagataaagacgactcttcttttcattacgacgagttgatctcgatttagatgaaaataagccaattagaaataaaataanaaaaatgaaaatagtgatgtattgtaaagaaaattccatattgctctcctaaatgaacaggaaaacaagntagcattaatagaatattacttcacattacaaataagcgtgtttgggatctgaatcgcaaaaacaaccttaaataaggtgaaaaactagcttttattaggactatgagaatttaaaaatatggctggggtactaggattcgaacctaggaatgctgagatcaaaacccagggccttaccgcttggcgataccccaattagataaatctttgattggatataaagaagacttttttgatagtatggctggggtactaggattcgaacctaggaatgctgagatcaaaacccagtgccttaccgcttggcgataccccamcgactatttgaattacaaagcgataaatggtgcgggacgagggacttgaacccacacacctctcggcgccagaacctaaatctggtgcgtctaccaatttcgccagtcccgcaaatttggtggctacagcgagattcgaacttgcgaccccaacattatgagtgttgtgctctaaccaactgagctatgtagccatcacttaatttgcttaaccatatcggctttgcggggcgtattatgctaattttgatgatcctcgtcaaatacttttttacaaraaaagtaattttatgtttgtttggttattaatgaagcatatcacttattttttattcatttaaacaacttatatgttatatggctttctcaacagccaaatttttcctaatcctatyttttcttttatgcgttcatttattgytaattaraatttatttgacamaaaatgcctaaatcgttatttctatacccactattctaaaaaaacacaacatctaggagtatcttatgccctatckctcagtcgccaaatttggcggaacatctgttgctaaccacgatgcgatgacagcttgtgcaaaaattgtcattgccgatcccaatacacgcgtagttgtgctttctgcatcagctggtgtaacaaatttattagtggctttagcaaatggtgtaaaagcgacagaacgtgaaaaattaattggcaatgatctgcatatcacttcaggtgtggcaaaacgtatttttgatactgttcaatcttataatgtgcgaatgattagttatggggcaagtaccaacaatgtttgtatgttagtacaaagtgaacattctgatgaaattgtacgctcgttacacaaatccttatttgantaaaatttaaacctaaagtgcggtgaaaaatcaccacactttttcttttatatcattgagattaaagccgaaaaagagtaaagtaaacggctgttcatttaactaatttaaccgaataaaaggcggaaattatgggaaaaagcgttgttatcttaggcgcacaatggggcgatgaaggtaaaggaaaaatcgttgatcttttgacggatcgcgtaaaatacgtagttcgttatcaaggcggccataacgcaggtcacacacttattatcaatggcgaaaaaaccgtattacgtttaattccatctggtatgttacatccaaacgtaacttgcttaattggtaatggcgttgtggtttcgcctgaagcattaatgaaagaaatgggcgaacttgaaagccgaggtattaaagttcgtgaacgtttattaatttcagaagcttgtcctttgattctgccttatcatgtggctatggatcacgcgcgcgaagcagcccttggcaaaaaagctataggtacaactggtcgtggtattggcccagcttatgaagataaagtagctcgtcgtggtttacgcgtaggcgatttatttaataaagaagcctttgccgaaaaactcaaaaacatccttgaatactataatttccaattggtgaactactacaaagttgaacctgtcgattatcaaaaaaccttagatgatgtaatggcaattgccgatgtaatcacaggtatggtggcagacatcactacaattcttgatactgcgcgcaaaaatggcgaacatattttatttgaaggcgcacaagggacaatgttagatatcgaccacggtacttatccgtatgtaaccagctcaaacacaacggctggtggtgttgcaacaggttctggttttggcccgcgtaatcttgattatgtacttggtatcattaaggcttactgtactcgtgtaggtggtggcccattcacgacggaattatttgatgatgtgggtgctgaaattgcgcgtaaaggtaacgaatttggtgcggtaacaggtcgtccacgtcgctgtggttggtttgatgccgtcgccattcgtcgtgcaatccaacttaactctatttctggtttctgtatgactaaattagacgtattagatggttttgatgaagtaaaaatctgtgttgcttacaaaatgccaaatggcgaaatcgttgaatatgcaccgttagcggcgaaagattgggaaggtgtagaaccgatttatgaaacattacctggttggaaagaaaatactttccgtatcaccgatgtaaataaattaccacaaaactgcattaactatattaaacgtattgaagaagtgactggcgtaccaattgatattctttcaactggccctgatcgtgtggaaacaatgattttacgtgaaccgttcgctgcttaatttcttttgattttcagaccgcactttaaaagtgcggtcnttttttatattttttactattcttcaatagaacgtaataattcattgatgcccacttttcctaaagtttttgcatccacttttttcacgatcacggcgcaatataggctatattttccacattttgatggaaggctacctgataccaccacagaaccagcaggtacacggccgtaatgaatttcgcctgtttcacgatcataaattttggttgattgaccaatgaatacgcccattgaaataacacaaccatcttcaacgataacaccctcaaccacttctgaacgcgcgccaataaaacagttatcgccaataatagttgggttagcttgtaatggttctaacacgccgccgattcctacaccacccgataaatgcacatttttaccaatttgtgcgcatgaaccaaccgtcgcccaagtatctaccatggtgccttcgccaacgtaagcaccaatgtttacataagatggcattaatacgcagtttttagaaatatatgcgcctttacgcaccgttgcagaaggcacaacacggaaaccttcttcagtaaaacgttcttcagtgtaatccgcaaattttaatgccactttgtcgtaatattttgtttctgcgccgtcaatgatttggttatcgttaatgcggaaagatagcaataccgctttttttaaccattgatgtgttacccattcgccagcaattttttcggctacacgatattttccagaatctaatccttcgatcacttcttcaattgccgcacgcgtttctgcatcaacggtttttggtgtaatttctgcacgtttttcaaatgcagcttcaataattgcttgtaaatttgacatagaacttcctatatacgttgtgaataaaacggcgttagttttaccatattttaaacgggcaagcaaaacaccgaaaaaaatcaccgcactttgtagaaacaaaactgcggtgataataaaaagttggtttgattaaaagattgaaagtgcaagccccacgacaacagacatactaaaaacaaccataatcattgcataaccaaaatcgctcattttgttctcctcataaaaaataacgcagacattctagcaagaataatacgaaaaaatcacttctttttataaaaaatttgcaataaagatgactaaattctcaacaaacctttataataggaaaaatttttagggatttaaatatatggcaacaattaaagatgtggcaaaaatggctggtgtgtccaccacaaccgtatctcacgtaattaataaaacccgtttcgttgcaaaagatacggaagaagcggtgttatccgcaattaaacaacttaattattcccctagtgctgtggcacgcagtttaaaagtcaataccaccaaatccattggtatgattgtgacaaccagtgaagcaccgtattttgccgaaataatccattctgttgaagaacattgctatcgacaaggttattctttattttgtgtaacacacaaaatggatccngaaaaagtcaaaaatcatttagaaatgttggcaaaaaaaagggtcgatggtttgcttgtaatgtgttctgaatatactcaggattcattggatttactttcatcattttccactattccaatggttgtaatggattggggcccaaatgcgaataccgatgtgattgatgatcatagttttgatggcggttatttagcaaccaaacatcttatagagtgcggycataaaaaaatcgggattatctgcggcgaactcaataaaactaccgcaagaacgcgttatgaaggctttgaaaaagcaatggaagaagctaaattaacaatcaatccgtcttgggtactagagggtgcatttgagcctgaagatggctatgaatgtatgaatcgtttactgactcaagagaaattaccaaccgccctattctgctgtaacgatgtgatggcgctcggtgcaatatcagcactaacagraaaaggcttgcgtgtgccagaggatatgtcaattatcggctatgatgatattcacgcctcacgtttctacgcgccaccattaaccaccattcatcaatcaaaactacgtttaggcagacaggcaataaatattctgttagaacgaattactcacaaagatgaaggtgttcaacaatatagtcgtatcgatataacccctgagcttatcattcgaaatccgttaaatcgattttataaacttaggnaaaatagaccgcactttttaaaaaatccctnaaaagtgcgggtcttttttagctattttttagcttttcttgattattttcaaaatttctctgaatagcatttgccctccaccctattttttngtnatanctatcgccaactgacaaattttattttttacttttaggagttcctatgacacaagagtacagtactctgcgcaataacattagtatgttagggcgttttctcggagaaaccatcaatgatgcacagggcgaggatattctcgagttaatcgaaaacattcgtaaactttctcgtaattctcgtgctggcgatgataaagcaagacaagcattgctcgatacgctcggtagtatttctaatgaaaatattattcccgtcgcacgtgctttcagtcaatttttaaacctcactaacatagcagaacaatatcaaacaatttcccgtgaacattctcttgcacaaagttcttctcaatccttaagcgaacttttcaaacgcttaaaagaacaaaatgcttcagtggaagaggtgcataaaaccgtcgaaaaattattaattgagcttgttttgaccgcacatccaacagaaacaacacgtcgttcattaattcataaacacattgaaatcaataaatgtttaagcaagctagaacatcatgatttaacggaaaaagaacgcaatattattgaacgtctattacttcgtttaatcgctgaagcatggcataccaacgaaattcgtactgtycgtccaacaccatttgatgaagccaaatggggctttgcgatgttagaaaacagtttgtggcaagcagtgccagagtttttacgccaactcaacgaaaccgcccgtgaatttttaggttacgatttgtcggtgggattaaaacctgtgcgtatttcctcttggatgggcggcgaccgtgatggaaatccatttgttaccgcacaaatcaccaaaaaagtgctttattttgcccgttggaaagcggcagatttattcttacaagacatcagcaaattagccgatgaactttcaatgatgaaatgtagcgatgaatttcgtgataaatacggcgaacatttagaaccctatcgtttcgtagtaaaaaatttacgcaatcaacttacagcaacattagcttattttgatgatcacttatctaatcgcacaccaagagtctccgaaagcgagattattttggaagataatcaactgtgggaaccactttacgattgttatcaatctttaattcaatgcggtatgcgcattattgcaaatggttcattgctgaatattttgcaccgtattagttgttttggcgtgacactttctcaaatggatattcgccaagaaagcacccgtcataccgatgccattgctgaaatcacgcgctatattggtttaggcgattactctcaatggatggaagacgataaacaagctttcttaattcgtgaattaagctctcgtcgtccattaattccgcaaaactggacgccatcgcctgaaaccaaagaaattttagatacttgtaaagtcattgctcaacaaaaacaaggtgtaatagcttgttatgttatttcgatggcgcgcagtgcantctgatgttttagccgttcatttactcttaaaagaatcaggcgtgccatatcacattcctgttgtgccattattcgaaaccttagaggatttagatgcagccgaaaaagtgatgactcaacttttcaatgtgggttggtatcgtggcgtcatcaataatcgtcaaatggtaatgattggctattcagattcggcaaaagatgcgggaatgatggctgcctcttgggcgcaataccgtgcgcaagaagccttagtaaatttaacagaaaaacttggcattgaactcactttattccacggacgtggtggcacaattggtcgtggcggtgcgccagsacatgcggcattactttctcagccacctcgttccttaaaaaatggtttacgtgtaacagaacaaggcgaaatgattcgcttcaaactgggtttacccgcagtagcagtagaaacctttgatctttacgccagcgccattttagaagcaaatcttttaccaccaccagaaccgaaaccagaatggcgcactataatggacgagctttccacgatttcttgcgatatttatcgtggtgtggtgcgtggcgataaagattttgtgccttatttccgcagtgctacgccagaacaggagctatccaaattgccgcttggctctcgccctgcaaaacgcaatccaaatggcggtgtggaaagtttacgtgcgatcccgtggatttttgcctggatgcaaaatcgcttaatgctgccagcttggttaggggctggtgcagctattcgtcaagttattgaacaaggcaaaggcgatattattcataaaatgtgcgaaaactggccgttcttttcaacgcgaatcggaatgttggaaatggtctttagtaaatcggatacttggctttcccaacaatatgatcaacgattagtgaaaaaagagctttggtatttaggcgaaaatttacgtaagcaacttgaagatgatattcaaactgtgctttcactttctcaccaaagtgaattgatgtctgatttaccttggattgcagattcaattgcattacgtaatatctacacggatccactcaatctactgcaagtggaattgcttcaccgtttccgtgaaaatccagagcaagtcaatcccgatgtggaacaagcattgatgattaccatcacaggtatcgcggctgggatgcgcaatacaggctagaaagatgaaaaaagtgcggaaaattttccgcactttttattcaaatcgatcacttaataaaaattgtaaaaccgcatccattctcaaatgaggaatactctccccttgttctaaaggctgaggttcaaaactatcaaaatcaaagtgcggttgtttttgccaaaattctgtttttggtaatttactcggcaccgttcctggataaagtgtaatcagctgtttatcaatagaacgaaccccttgaattgctttaatttcttttccttgctgattcacgatcacttgttttgtggtacgaacagccgcaatggcggtatattctgtatcaattccttcaaattctacatggcgaccgccctcttgcacaatttggcgcattaaactcactaaattaggaatttgatcacgagtaatatgatccgccttggtcgcaacaaacattaatcgatcaatttgcggagaaaacaaacgatgaagaaaatttctgctgccataatggaaattattaaataactgatttaagcccatttgcatatctaaaaaggcttgctgactgtgatttaaaggcgttaaacaatccgccaaaataacttgacgatcaaaggtagaaaaataattttcgtaaaaacctttcacaattttattgcgataataattataacgttttgtcagcacggcaaaatagctattcgatttggctgtttttttcaaggtttgccaatgttctcccgaaagatgaattaatggaaaaaattgtaatgcaggagccccctctaaatcactcggcaatacaaatcgcccaggctgaataaattgcatgccttgcgctttgcattgatgtaaataatccgtataacttttcgctatcttggctaaaacatcttcatttgcgaccgcacttaaatccaaattctgcaacatggaaagccaattttgcgccaattctgcacgaacgccagttgtgaccttgatttgctcttgtgaccattgttgaaaatctaaatttaacaacggcaaatcgagcagccattcaccgggataatcaaaaatatccagataaagcgtgcctcgttctttcaaatggcgtagcaagccagattgacgttgaaaacgaattgctaaacgagtttcactcacgccacgagtagattgaaaccattgaggcggattttgtgacaaatcatttaaattactttcataatcaaaacgtggcacgctgagatcttgttgggatactcgtttgactgccaaaattgaaccatttctagctgcttcaaacaagggcaaattctgtgatgaatgttgattaatggagagaagttgattgattaaacttgtaataaacgctgtttttccactccgacttaaccctgttaccgccaagcgcaaagtgcggtcaaaaccacgattaataatttgattgatttccttttgaacccgattaaacattcaatatcctagccatttttactaatatgccttacaatttgacacataatttatcacaatgcatttgttatgttacgtctaaatctgagatttttatcttttctgctctgtataatccaaagtgtagaattacaggctgcgccaagtgttccaacatttttaactgaaaatggcttaacttattgcacccacgcttcaggtttttcatttaatccgcaaacggcagatgcaggaaccagtatgaatgtggtcacggaacaaatttataacaaattatttgatataaaaaatcacagtgcaacattaacaccaatgctggcgcaatcttattccatttcagctgatggtaaagaaattttattaaatttacgtcacggcgtaaaatttcaccaaaccccttggtttaccccaacacgtgattttaacgctgaagacgtagtattttcgattaatcgtgtattaggggggcataatacttatttaccaaccttagcagagacgaatgttacctatagtaatccacaatatagagtgtttcacgaacaagcaagaaaagtgcgttttccttattttgatagcattaaacttaacgaaaaaatcaaatctgtgaccgcactttcgccttatcaagtaaaaattgaattatttgcaccagattcctccatcttgtctcatcttgccagccagtatgccattattttttcacaagaatatgcctatcaattaagtgcagatgacaaccttgctcaattagatacccacccagtaggaacagggccttatcaagtaaaagattatgtatataaccaatatgttcgcttagtgcgcaatgaaaattattggaaaaaagaagccaagatagaacatattattgtggatctttctactgatcgcagcggacgtttagtcaaatttttcaataatgaatgtcaaatcgcctcttatcctgaagtaagccaaattggcttattaaaaaatgatgacaaacattattatatgcaatctactgatggtatgaatttagcctatttagcgtttaattttgataagccattaatgcgagatcacgaaatccgtgccgctatttcacaaagtttaaaccgagctcgaatcattcatagcatttaccataacacagcaactgttgctaataacattattcctgaagtatcttgggcttcaagtgtcaatacgccagaatttgagtttgattacaatcccaaaatcgccaaaaataaattagcagataaaaaccttttgttaaatttatgggtaattaatgaagaacaagtctataatcctgcaccttttaaaatagctgaaatgataaaatgggatttagctcaagcgggtgtgaaagttaaagtgcgtgccgtaactcgtccatttttaactgcgcaattacgcaatcaatcggaaaattatgatttgattctatctggttggttagctggtaatcttgatcctgatggttttatgcgtccaattttaagctgtggaacaaaaaatgaactcactaatttatctaattggtgtaatgaagaatttgatcaatttatggatcgtgccattaccacctcacatttaagttcacgcgcaaaagcctataatgaagcccaagaactcgttttacgtgaattacccattattcctattgccaatgtaaaacgaattttagtcgcaaatagtcgtgtgaaaggagtaaaaatgacgccttttggtagcttagatttttccaccttatattttattcaggagaaatactaatgttatggtcggttcttcgccatattctgtgggtggcattattattactcgtattatcgctattaggctttgtcattttattgcgcgatcctcttaatgcgaatcttgttacacaaaacatttatatcggctatttccattatttaggcaccttgttacaaggtgattttggcattacctataacggtggaaaatcattaatgaaccttantcttacggttcttcctcccacattggaactttgtttcattacattgtttttggcatttatttttggtttgccacttggcattataagtgcggtcaattctgaacaagtttttgcaaaaagtttacaaatcctatcttatgtagggctatctattccaatattttggttagcccccattttactgtatgttgccgcgctctcacattgggaaattgccgctattggacaatataatttgctttacgaaattaaatccattacgggatttcctgttattgatatgtggtttatggaagtaccttatcgtacaaaaatcgtacaaaacatattgcaacatttagccttaccaacattggtattgtgtattttgccaacaatggaaattatccgcattattcatcaacgagcagaatatattttgaatcaaaatttttctaaagtagcgacaacacggggttggtcaaaatggaaaattctccatcaatatgtattccgtaatacttttcccctgcttgttccacaagtaccacgtgtattcacattagtattaacgcaatgtatgttggtagaaacggctttaggttggcctggcattggtcgttggttaattaatgccgtaaatgaacaagattacaacagcattgccgcaggtgtaattgttattggtgtatgtattattttgattgatacattcactaaaatattcacttttatactcgatccatttaaaaagaaaggttggtatgcaaaataaagaacctgatgaattccgcgaaagcacctcaatctttcaaatttggttacgctttcgtcaaaataccatcgcactttttagcttttatttattaatcgcattaatttttaccgcactttttgctagttatcttgcaccttatgctgataatcgacaatttattgggcaagaattaatgcctccatcttgggtagatagaggaaaaattgcttttttctttggtactgatgatttaggtcgcgacatattaagtcgtttaattatgggtactcgttataccttaggttctgctttactggttgtcttttcagtggcaataataggcggcgcactaggaattattgcaggactactgaaaggtattaaagctcgttttgtcgggcatatttttgatgcttttttatcgttacctattctattaattgccgttgttatttcaacattaatggaaccaagtttatggaatgcaatgtttgctacgctattagcgattttgccttatttcattcacactatctatcgtgctattcaaaaagaattagaaaaggattatgttgtaatgctaaaacttgaaggcatttccaatcaagccttattaaaaagcactattttaccgaatattactgttatttatattcaagaagtggctcgtgcttttgtgatagccgtgttggatattagcgcgttaagttttatttctcttggtgcacaacgacctacaccagaatggggggcaatgataaaagactctttggaactactttatcttgcaccttggacagtacttttacccggtttcgctattatttttactattttattaagtattattttcagtaatggcttaactaaagccatcaatcaacatcaagaatagcctatggcacttttagacatttgtaacctcaatattgaaattcaaacctccaatggacgtatnaaaattgtagatggcgtcaatctttcccttaacgaaggggaaatcagtggattagttggcgaatcaggctcaggaaaaagcttaatcgctaaagtcatttgtaatgcaatcaaagraaattggattattactgccgatcgctttcgttttcacgatgtcgaattacttaaactcagtcccaataaacgccgaaagttagtgggtaaagaaatatccatgattttccaaaatcccttatcttgccttgatccaagtcgaaaaatagggaaacaactaatccaaaatattcctaattggacatttaaaaataaatggtggaaatggtttgggtggaaaaaaagacgtgctattgaattgttacatcgcgtaggaattaaagatcatcgtgatattatggcaagctatcctaacgaactgacagaaggcgaaggacaaaaagttatgatcgcaatggctgtcgctaatcagccacgtttattaatcgcagatgaaccaacaaatgcattagaatcaaccactgccctacaagtttttcgtttactttccagtatgaaccaaaatcagggaacaacaattttacttacgagtaacgatattaaaagtattagtgaatggtgcgatcaaatttcagtgctttattgtgggcaaaataccgaatctgccccgactgaaatattaatcgaaagtccccatcatccttatacccaagccttaattaatgcagtacccgattttactcaacctttggggtttaaaactaaattgggtacgttagaaggcaccgcgcctattttagagcaaatgccaattggctgtcgtcttggcccaagatgcccttttgcacaaaaaaaatgtatggaaaaaccaagacgattgaaaataaaacaacacgaattttcttgtcattatcctattaatttacgagaaaaaaatttcaaagaaaaaacaaccgccaccccttttatacttaattgcaaaggaaatgaataatgcccttattacaagtggaagatttaactaaaacttttaaaggtcacgccagtttatttggtcgaaatcaattcaatgcagtggataaagtgagttttacccttgaacgtaaacaaacacttgcaatcattggcaataatggctctggtaaatcaaccctagtgaaaatgatagcgggcattattccgccaacttctggtcgaattttatttaatgatcgagaattacaatatcaggatgcccaatctagagctaaacatattcgtatggttttccaagatgccaactctgcatttaatccacgtttaaatattggacaaatattagacgaaccattaagcctagcgacagattggacagaaacacaacgtaatgaaaaaatctttgagacgctctctcttgttgggctttatcctgattacacaaatctcaatattaagcatctttctattagccaaaaacagcgtgtcgctttggcacgtgcgctgattttagaacctgaaataattattatagatgatgcaattggtaatttagatgcctcggtgcgcattcaattactaaatttaacccttgatctgcagcaacgtttaggtatttcttatatttatgtagggcaagatctcggtgtaattaaacatattgcagatacgattatcgtaatggatgaaggaaaaatgattgaatatggcagccctcaaaatctttttactgatccacaaactgatgttactcgtcgcttagtcgaaagctattttggcaaaattttagatgaaaccgcttgggtaaaagacaaaaacgctcactaaggaaagaaaaaatgaacactcgtcccttttatttcggacttatatttatcgcgattatcgctgtacttgctaactatttaggaagcaccgacttttcccatcattatcatatcagtgccttaattattgccatcttactgggaatggcaatcggcaataccatttacccgcaattttcttcacaagtagaaaaaggcgtattatttgcgaaaggcacgcttcttcgtgctggcattgtgctgtatggttttcgtctcacttttggcgatattgccgatgttggcttaaatgctgtcgtcactgatgccattatgctaatttcaaccttttttcttaccgcacttttgggcattcgttatctaaaaatggataaacaattggtttatctcactggggcaggatgtagtatttgtggtgcggcagcggttatggcggcagagcctgttaccaaagcagaatctcataaagtttcagtggcgattgccgtagtggtcattttcgggacgctttctatttttacttatccatttttctacacttggtcacaacatttaattaacgctcatcaattcggtatttatgttggctctagcgtgcatgaagtggctcaagtttacgctatcgggggaaatatagatcctatcgtggcgaataccgccgtcattaccaaaatgctccgagtgatgatgcttgcaccatttttattcatgctttcttggttattaacacgtagtgatgggatatcagaaaatacatcacacaaaattacaattccttggtttgctgtactttttattggcgttgccatttttaattcttttgatttattaccaaaagaactcgtgaaattattcgttgaaatcgattctttcttattaatttcagcgatggctgcacttggcttaactacgcaagcaagcgcaatcaagaaagctggattaaaaccgcttgttttaggcgtattgatttatttatggctagtgattgggggatttttagtgaactatggaatatcaaaattaatataaattcacttaacattgaccgcacttttaaagtgcggtctttttttatgaagaatattttcagatatggttatttaaaagatgaaattacgctttatttcaaaggacgatttaataaaccatcctctaaaaataaagggccaattgggcgtttaggaatatcaaacttttgtggataaatcacatccaccaaatacaatccatcgggttttgctgttggtgcggcaagctgacgatttttctgctcaagcagccattgcatccattcaatcggctgatttccagtaccaacctcaatcaaacttcccacaatattgcgcaccatatgatgcacaaaagcgttcgcctgaatatcaacaataatatattttccgatacgagacacattcaaatgatgcacattacgccaaggcgtatgagactgacattgcgccgcacggaaagaggaaaaatcctgttcgccaagtaaacattgccctgcctgatgcattttttccgcatctaaatctaaatgacaatgggttattcctcccgctaaaatcgcagagcgtaatttattacaataaagaatatagcggtaacggcgtgctgttgcagaaaatctcgcatggaattcatcatcgacttgttttgcccaactcactgcaatgtcatcaggtaaatgagcattcgtaccaaaagcccaagccttctctggacgaaccgcattggtttcaaaatgaacaacctgacccgttccacttacgccagaatccgttctgccagcacaaaatatttcaattttttcatttgcaatgtgagaaagtgccttttctaattcttcttgtacactgcggactttttcttgtctctgccaaccataataattttgcccgttatactcaatgcctaatgcaattttcatttttwaccttttggcttaataaagtgcggttatggtagcccaagtttatttggagcgcaaatgcataaaaacactccaaaatttattcaaaaataagcgatagtttctaaaaattgcagtaataaatgtgaattttttgtgataaagatctcattctgataatctgccattagagtttacactccagattccctataattgatcaacgtattatgaaaaactaaaaggaaattatgaaaacattgagtgaatttatcgttgaacgccaagctgaatatccaaacgcaaagggggaattgagtggtattttgtcgtcaattcgtcttttagcgaaaataattcatcgagatattaacaaagcaggtttaacaaatattctcggtcaatctggtattgaaaatgtacaaggcgaaagtcaaatgaaactcgatttattcgcccataacacgatgaaagcggcattaatggcacgtgaagaagtggctggttttgcctctgaagaagaagaaagttttatcgcatttgatacagaacgtggccgtaatgcaaaatatattattttaacggatccccttgatggttcttcaaatattgatgtaaacgtatctgtaggaacaattttctctatttaccgtcgcgtatctccaattggctcacctgttaccttagaagattttatgcaaccaggtaataaacaagtcgcggctggttatattgtttatggttcatcaactatgttggtatataccactggtaatggggttaatggttttacttatgatccatcaatcggtacattctgtctttcccacgaaaatatgcaaatgccaaaagagggcaaaatttattccatcaatgaaggacaatacctcaaattcccacaaggtgtaaaaaaatatattaaatattgccaagaagaagataaagcgactcatcgcccttacgtatctcgctatattggttcacttgtagcagacttccaccgcaatttattaaaaggcggcatttatatttacccaagtgcaaccaactatccaaatggaaaactccgtttattatatgaaggcaatcctattgcatttttagcggagcaagctggtggtgtcgcaacagatggttatcgtcgaattttagatatcgaaccaaccgcacttcatgaacgtgttccactatttgttggttcagaagatatggtaaaaaaagcacaagaaatgatggaagaatttaaagaataataaaaagcatcatctgctggttttagcggcgcaacttcacgatttctatcacgaaaatcacgctcttttatctcggctaaaatctgtgcaaagttaccatttattcctttattttgcaactgtttatagcgtctttttgcacgttcttcagcacttgcatctaaaaataattttacttgtgcatttgggaataccacagtccccatatctctgccatccgcaattaatccatcatttttcgcaaaatcttgctgaagttgtaataaagctgaccgcactttttgaaagactgctacttttgacgcagcatctgccacttcttgcgtgcgaattaaacggctcacatccattcctgcaagaaaaatgtttacctcgccattttgaggaataaattgaatatctaaatgacgtgctaattctgctaaatctgtttcatttgttagatcagttttacgttgcaacgctgccaatgcagtaacgcgataaatcgccccactatccaacaatgcatagcccaacttttcagccaacgcataacaaagcgtccctttcccagcaccactaggaccatcaacagtaataatcattcccatacaaattatcctttcattctcaaaattttgcgcattatagagacaattgcccctcattaccatcctagagattattactagcttccatgttttgtatggcttatctaataaagttaatttcacaagctctaggaaagcgtaaactccctttcaagctttttcttaaatttcagaaaatctaaccacatagaaaaaggtttttaaaaacatttcaaggtttttttaataactattgtggcacttaaggacgaaattctttcagctaaagtagctcttttttctattattaaattggacaatccttctgacgttctacacttcgtttatacaaaaaactgaaattaagcacgctagacattatgccttttaatatatacacattttttcaaacttgttctaaagacttttctacattacaataaaaaacgtagctatcaatacaaataatcaaataatgaggacaaagaaatggctgaaaatcgttatgaactaaataaaaacttagcacagatgctcaaaggtggtgttatcatggatgttcaaaaccctgaacaagctcgcattgcagaagctgctggtgcagctgcagtgatggctttggaacgaattcctgcagatattcgtgctgttggaggtgtctctcgaatgagcgatcctaagatgatcaaggaaatccaaggagcagttagcattccagttatggcaaaagttagaattggacatttcgttgaggctcagattttggaagctattgaaattgactatatcgatgagagtgaagtgctttctccagctgacaaccgtttccatgtggacaagaaagaattccaagtaccttttgtatgtggtgccaaggatttgggcgaggccttgcgtcgtatcgctgaaggggcttcaatgattcgtacaaaaggagaaccaggaacaggagatatcgtccaagctgttcgccatatgcgcatgatgagtcaagaaattcgtcgcattcaaaatttacgtgaggacgagctctatgttgcggccaaagatttacaagttcctgtagaattggttcaatacgtccataagcatgggaaattgccagttgtcaacttcgcagctggaggaattgcaactccagcagatgcggccttgatgatgcaacttggcgcagagggtgtctttgttggttcaggtatttttaagtcaggagatcctataaaacgtgcgagcgctattgtcaaagctgtaactaactatcgaaatccacaaatcctagcacaaatctccgaagatttaggtgaagccatggttggtatcaatgaaaatgaaatccaaattctcatggctgagcgaggaaaataaatnaaaatcggaatattagctctacaaggtgcctttgcggaacatgcacgaatgctagaaaaattaggaattgaaagtgtcgaactgagaaatttaaaaaattttcaacaacattacagtgatttatcaggtttgattctacctggcggtgagtcaaccgccataggaaaacttttaagagagctgtatatgctggaaccgataaaacaagctatctcttctggctttcctgtctttggaacttgtgctggtttgattctgttggctaaagagattacttctcagaaagagagtcattttggaacaatggacattgtggttgagaggaatgcctatggacgccaattgggaagtttctatacagaagcagattgcaaaggggttggtaaaattcctatgacttttatcagaggacctatcatcagtagtgttggtaaaaaagtcaatattcttgcaacggtaaataataaaatcgttgcagcccaagaaaagaatatgctggtaacatcatttcatcctgaattaacaaataacttgagtttgcataaatactttatcgatatatgtaaagtagcataaaccattatctgcatatctgccctccctaggaaacaaaccatattgtagcaatgagagcagataattttcatcaaaaaaccgaacagttactagacttaaaaccgaatgcaaggcaggataaggatgaacaaaacaaaatttcttgttgtattgacgagagcaaacgccacttcgtaattgggctttccccaaaacgaaccaaaatcaacaatcctaaagacattacacaccattgagtatttacaaggtttcaatgcggactgaatcatctatgaaagcactgacggtttggatcttacgattgccaaaatattatatcaagcagcctttttcgtgctcattgccaatccacgacaaatcaatcactttacaatgtcacatttagtaaccaacaattactgtacaagtgtagactggaataagtcaaataattttgcggtaaacatcagataatttgctgaccttattttgatgagttggctctatctaagaagaggaaataataaacaagcggtcacatttgacatcttgtttgcattttagaggtttattccgcccagtattttttcctcgtcgttttaccaatacctggattaaagctattggttggwtccaactctttatagaattttctcaaggttggtttagcctcgtataaatgccctacattgtgttcggctgggtattgcgcaccacgcttgtcaagtaatttcaacatttcgtattctagttcttcataatcataacctttttttacaatgtaatcttggtgaaagacatggcacataaaatgtccgtagtaaagtttagagataattctgttatcaatttctggcggtaacacttcaaaccaatcttgatcattgcgacgtaatgcaacatctaaagcaactatttcttctacttctttttcgtgaattgcacgataacgaattgcagcacttgcaacagcgaaacgatgaagcattgctgcttgggtttcgattgcattacattcaaaatagccaccttttgagccatctgcaatgtaggattccaaatattcacgggcttcttgaatgccttttccacccattttgataattaagtgatgctcgtatttgttgcgataatcccataagctttgtggaagatgttctgggatgaatttagacacagtttgcataaatttatcgcttaaatgttgtggtaaaaagaagaattttttgccgatgcgatccacgtttgattttaaggaaaagagttttggtagccaatgtgtaccaaactttttaatgacccaaaaggtatctttgccatattttgctgcgatgtcaaatgcatcacgatggatatattcacctgaaatgggtagcacttcgaagtttactaacatgtggcgacgaatatcgctcaacacagaagtttgattggtgccgatatagaaaacagccgtctctttttcaagcggaaaggtgtctaaacgaaccgcaaagacagcaagttttcctgcacagcctgaggcttcatagtggcgagctgggtcggcattaaaacgagcaggggagccttcatcaacttgacgaacatagttgcagtagtaatggtcgtgaccatgtccgcaatcttgtcgaatatctttaacctgataacgtttttcttgtagattagttaaaatttcttcaggagtttctcctaaatcaatgcctaaatgattttttagttctaattcacctttttcattaagttgagcgtaaagtgccatttctgtataggctggtccacgttgaactaatgctccacctgagttgttacaaatcccaccaataactgatgcgccaatgcaagatgagccaataacagagtggggttcacgaccaaacggtttaagttgattttctaattcattgagtgtagagcctggtaagcaaataacttgggaagcgttattgatgagttggattccgtcaattcgcattgtattgatgacgacaatatcgcgatcataatcattgccatctggtgtagagccaccagttaaacctgtattcgccgcttggtttataacaataacatcatgttcaacgcaaacttttacaatgttccaaaactcaagtagagtggcagggcgaactacagctagggcgtttcctgttccaaatcgataaccacttcgataagcttctgttttagttggatcagtaataatataacgagagccaacaatatcggtcagtcgtgaaatgagttgttgaacagacattttattatcctcttgtaataagaattaatagcactataacagaataattcccatttggataaggatattttaggctttaatcggtgttttttttggaattgctctacatataaagaaaattctctctttatgataggttcagtgctgtatgggtatttcaatcactcaatatcagcaatgcaaaatccgttgaaacctttaaagatagagaaaaatattatttaacaaacgaaacttttactgaaatacaacctattgatatgccaaacgaacgtaatattcaaaattatcactcgacttacaacaacattcgggattggcttggttatcaaaaagctggcgaggaaaaagcaaagtcgaccatcaattaggaattgggatgaggtagtttttgaagtgaattttaagcacaataaaaaaacatcagaatttttagccgcactttctaaagtatccgctaatttacataaatgatttaaccctacctatgctgctactcttttaattttatgaacagtattttctgtttctttcatattatcttttgataattgagtaagataattagacatggtttgtttgaataaagataaattttttaaaatttttgatttaccatgcgtttcaatcaatgctaaatcaaactgttctgaaagcttattatcattcatttctataatagattctctttcatccacaaaaaatttctgcaggcaatggtgtaaatccttaattgaaatgagtttacgtaatatgccatccattccaatttcttaatgttcctgctcgctttacataacattgacggtaaaaaatcataaataccattctaatagttttctcgcaaatgttgccacttgttgtccgcagaacaataaccaactctctaagcaatttagttctttatatcctaagttttgaatcattataatgtattttgctttgcacgccttcgtcatacgtttattttttggcatatcgttagcaactactgaatgaagcaaagaacgtaatgttattaacatcaatatgctttaatctttcagcgtaactatcaaaatcattgtaatgaaggtaagatctatttatccccaattgaggatttatttaacaatgaaattatggcttataatttagtgctaagtccgaactttgagtaaattaaccaaatgatgaaacaagccgtagcaaggcttgatgaagcaaaaccgattttacattccgaccaaggttagcaatatcagatgatagattatcaacacatactcagggagaatggcattcaaagtatgtgaagggaaattgtttagataacagtagaatggaaagcttctttagatgttttaataactggaaaaaaagctccatgagcgtattcagaagaggctaaagactgagccctgtgaatgacagaactcagtccttgagctaaataagtctaactttttgaggtcagatcatttatcaataaactgatcaaaaaaaccgaacttaatgttcgcttttctttttcattacataatacgacgcgattgagtgtaggttctagcccaatatttttcatcaagggaacttattgtcacgccttgccctgtacttgcgtgcataaattggttattaccaatataaacaccaacgtgattatttttacggaagaaaactaaatcgccttttttaagttctgatttattaatttttctacctaaatgacgctgttcagccgtagaacgaggcaattcaataccaaaaacttcagaaaaagtagtttgcataaatgctgaacaatcaataccacgtttagtggtaccgcccatacgatagcgagtgccaacccattcattataaacactggctagagccttatcgcccatcaaagcagaggaacggtttgttctcactttgtgaaaaatgcctgttcgattatctttttctaaattattaattaaaccagttaattgaatatcatcattttctgaaataacctgatgacttaccgttcgtggtgcattagaacaagcggttgctaatacagctaaaccaataataactaaaattcttttcaacataatttcaaataattaaaagaaataaaatttcgcagcggctatcaaaatttgaataaaattgccagtaaaaatccaattctaatggaatttttgtgatcttttacacaatgacttaatttgttccaccaacagtaatttcatcaatttttagtgctggctgtcctacgccaacaggtacactttgtccctctttaccacaaaccccgatacctaaatcaagctctgatttatctgcaaccatagaaattttttgcatcacttcaatgccactgccaattaaagttgcacccttaactggtttcgtgatttttcctttttcaattaaataagcttctgaagtagaaaatacaaatttaccagaggtaatatccacttgccctccaccaaagtgcggtgcataaatgccctgttttacagaagcaatcaaatcatcaaactgactttgtccagcaagcatataggtgttagtcattctaggcattggtaaatgggcgtaagactcacgtcgtccatttcccgtagtgctacgcccatcaaacgggcattcattttatcttgcatgtaaccttgcaaaatcccgtctttgatgagtacattgcactggcttggcacaccttcatcatcaatagttagtgaacctcgacgattttcaatcgtgccgtcatctacaattgtacataatggagaagttacttgttcgccaatcttgcctgtaaaaagtgaactttctttacggttaaaatcgccttctaaaccgtgcccaacagcctcgtgtaacagcacgcccggccaacccgcacctaatacaactggcatcaatcctgcgggtgctgcaactgcactaaggtttactaaggcttgacgaaccgcttctttagcaaaaagtactgctctaatatcgccatcaacaacttcaaagaaccaatctaaaccgaaacgcccaccagaaccacaacttcctcgttcacgttttccattttcctctactaacacagaaatagataagcgaactaaagggcgaatatctgcggctaatgtgccatccgtcgccataattaatacttcttcataaacggaactgaggcttgctgaaaccttggttacacgatgatcttctgcgcgcgctgtacgatcaaccaaatgtaatagctcaatttttttctctttagtcaaactttccaaaggattaatcgccgcataacgagcaataggatttacaacattaaaagcggatggcgaaatcaaattcccctgtttgacttgcgcgatcccctttaccgcctccgcacattgctgcaaagaagcaagattaatttgatccgcataagcaaaccccgttttctcgccagaaactgcccgcacaccaacgccacgatcaatatgaaaactgccttcttttataatgccgtcttctaatacccaactttcatcttggctaagttgaaaatacagatcggcataatcaatattgcgatgcgacataatgtcaaaaatattgagtaatgtttgagttgaaagattacttggtgtgagtaatgtatttgaaacttggtttaacatattttttccagtctaaagtaaatatcttgtgagtgcttgtatccgtttaatacaacagcacagattaaaatcggattaataaagtgcggttgattttgaggttatttttccaaatgcgctaatccaaattgatacaaagcattcttcttataaccatacaactcagcaactatagctgctgcttttttaagtggcaattcttctgcaattaactcaagtgcctttaccgcttgcggcgaaatttcatcgttattgtcagactttggtttgccttccacaatcaaaaccatctcgccttttgtacgattgggatcttctaaaagccattcgcgtaaatttttaatcgtattccccgtaatcgtttcccaagttttagtcatttcacgggctaacacaatgtatcgttcttcccctagcaccgcttgcatatcttctagtgtatctaaaatacggtgagtggattcataaaaaatcaaagtgcggtcttcttctgcgatattttctaatttatctttgcgtgctttacttttcgcaggtaaaaagccttcaaaacaaaatctatcagaagcaatccccgatgcacaaagagcggtaattgccgcacaagctcctggcaaaggcacaactcgaatgccagcttcacggcattggcgtactaaatgaaaaccagggtcactgattaatggcgtccccgcatcagaaatcaaggcaatattactcccctgcttgagcttttccaccaaaatatgcgctttttcttgttcgttatgatcgtgcaaagcaaaaaatggcttcttaatgccgtaatggctcaataaaagtccactatggcgagtatcttctgctgcaattaaatccacttgagcaaaagtctctaaagcacgttgggtaatatcttgtaaattgccaatgggcgtggcaacaatgtataaaattccggttaaatcagtcatttttgtttgcttttaagttatgagataagtaagatctgctacgactattgtctgtttatgatggagcaaagatgtctattctattacaaggcgaacgttttaaaaaacgtttaatgccaattttattgtcaatggctttagctggctgttcaaatctacttggtagcaatttcacgcaaaccttacaaaaagatgcaaatgcaagttctgaattttatataaacaaattagggcaaacacaagaacttgaagatcaacaaacctataaattgctcgcggctcgagtgttaatccgtgaaaataaggttgaacaatcggcagcgttattgagggaattaggcgaattaaatgatgcgcaaaaattagatcgtgcattaattgaagcgagaatttctgctgcaaaaaatgccaatgaagtcgcacaaaatcaattacgtgcattggatttaaataaactaagcccgtcacaaaaatctcgttattacgaaaccttagctattgttgccgaaaaccgtaaagacatgattgaagcggtaaaagcgcggatagaaatggataagaatttaacagatgtacaacgtcatcaagataatattgataaaacttgggctttattgcgttcagcgaatactggcgttattaataatgcctctgatgaaggtaatgcagctttaggcggttggctaacattaatcaaagcctacaacgattatattcgtcagcctgtacaattaagccaagccttacaaagttggaaaaatgcttatccaaatcatgcagccgcaacgttgttcccaaaagaattgcttacattgcttaatttccaacaaacgaatgtgtcacaaattggtttactcttgccattaagtggtgacggacaaattcttggcacaaccattcaatcgggttttaacgacgcgaaaggtaactcaaccattccagtgcaagtgtttgatacctcaatgaattctgtccaagatatcattgcgcaagcaaaacaagcggggattaaaaccttagttggcccattactaaaacaaaatcttgatgtgattttagcagatcctgctcaaattcaaggtatggatgtgcttgcattaaatgccacaccaaattctcgtgcgattcctcaactttgttattacggactttcgccagaagatgaagctgaatctgccgccaataaaatgtggaacgatggcgtgcgtaatccacttgtcgcaatgccgcaaaatgatttaggacaacgcgtaggcaatgcctttaatgtacgttggcaacaattagcaggtactgatgcgaatatccgttactacaatttgcctgcggatgtgacctatttcgttcaagaaaataactcaaatacaaccgcactttatgccgtagcaagtccaactgaactggcagaaatgaaaggttatttaacaaatatcgtacctaatttagcgatttatgccagttctcgagcaagcgcaagtgcgacaaacactaataccgacttcatcgcacagatgaacggtgtacagtttagtgatattccattttttaaagataccaattctccacaatatcagaagttagcaaaatccacggggggcgaatatcaattgatgcgtttatatgcaatgggtgcggatgcgtggttgctcattaatcaatttaatgaattacgccaagtgccaggctatcgcttgagtggcttaacagggattttaagtgctgataccaactgtaatgttgaacgcgatatgacttggtatcaatatcaagatggtgcaattgtaccagttgcaaactaatgttttctttaaaacgtcagcaaggggcgagctttgagcatcaagctcgtctttttttagaatcaaaaggcttaatatttattgcggctaatcaaaatttcaaatgtggtgaacttgatctaataatgaatgacaaagaaactatcgtctttgttgaagttcgccaacgaagtcattccgcctatggttctgctatagaaagcgtagattggcgaaaacaacaaaaatggttagatgccgcaaatttatggcttgcaaaacaaaatatgagcttagaagatgctaattgccgctttgatttaatcgcttttggcaaaacacctcaagatattcaatggattcctaattttctcgattaatggctttttataatgttacaaaaagtaaaagatatttatagcgaaagtattcaaattcaaattgcagcatcaagtatgctttctgaaaatattaccaacgccacccaaatggtgatgcaatgtttattaggcggtaataaggttatcgcctgtggcgtgtcgcgttcttatgctaatgcacagtttctcgtctcaaacttacttaatcgatatgatttagttagaccgagcttcccgtctgtgttattgagcttagaaagtgcggtgggttcttcacttgtttttgaacaaccgcctgaagaattgtattgtcatcaatttaatgccagtgcaaaatcgggcgcacttacttattgcttttgcacctttggggacagaaaaaatcgtgctaaatattatttctcatgctgtcagcaaagaagttaatgttattgtgctaactggctctaacaacgatgccattcaaggaattttagcagataaggatctagaaatatcaatcccagccaccaaagaaagtcgtatcttagagaaccatctttttgtgattaatgcactttgtgaattggttgatcagactttattcccaagtgcttgacaggaaaataaatcactttcaaactaatagtaatttaatctaaaaaggagttaattatgacattatccccgttaaaaaaactcgctatcctgcttggagcgactatttttctacaaggctgtgttgcagctgtgattggaggtggtgctgtagcagctaaagtagctaccgatccccgaacgacagggacacaaattgatgatgaaaccctcgaatttaaagtagaaaatgctgtagaaaaagatgcccaaattaaggctgaaggtcgtgtaaatgcagtgtcttacaatggccgagtacttttaatcggtcaagttcctaatagtgatgtaaaagacactgccacagctcttgcaaaaggtgttgaaggtgtcaatgaagtttataatgaactaactgttagcccaaaaatctcttttgcacaaatcagtaaagatagttggctcacaacgcaagtcaaatctaagatgttcgttgatggtcgagttaaagccacagatgtcaaagtgattagcgaaaatggagaagtatttttactgggtaacgtcacacaatctcaagccaatgcggcagccgacattgccagcaaaatcagcggcgtgaaaaaagtaattaaagtattcaaatacctagactaatccttcaaagtgcggtgaaaaattcaacaaatttttaccgcactttttcttatttttctaaataaaaaattttaatttttattctcacaaaaaccgtttatttttaaataagttatctattgtcaagaatcaaatcaaaaaatttattacttgcgatcttttctcaaacacattatcttgtggatcgttttcataaaaacactatatcttgtgttttaaatcctgttttaaataacaacaagaaggctcatacaatgaataaaagtttaatggttacaaagcgtgacggtacgcaagaacaaatcaatcttgataaaatccatcgtgtgattacgtgggctgctgaaggactagacaatgtttctgtttctcaagtagaacttcgttcacatattcaattttatgaaggcattcgcacttcagacatccacgaaaccattattaaagcagccgcagatttaatcagcaaagattcgccagattatcaatatttagctgctcgtttagcgattttccatttacgtaaaaaagcctatggtcatttcgatccccctcgtttatacgatcacgtcaaaaaactagtacgtatggaaaaatatgatcaagcgttattagatgattatactcgtgaagaatgggacacaatggacggcttcatcgatcattggcgtgatatgacgttttcttatgcagcagtgaagcaattggagggtaaatatttagtacaaaaccgtgtgacgggagaaatctacgagtctgcacaattcttatatttgctggtttccgcaagtctattctctaaatatccaaaagaaacacgtttggattatgtaaaacgtttctacgatgccacatcgactttcaaaatttccttacctacaccaattatggcgggcgtgcgtacaccaactcgtcagttcagctcttgcgtattaattgaatgtgatgacagtttagattctatcaatgcaacagcatcagctattgtaaaatatgtttcacaacgtgcagggattggtattaatgcaggggctattcgtgcattaggtagcgaaattcgtggtggagaagcattccatacaggttgtattccattctataaatatttccaaactgcagttaaatcttgctcacaaggtggcgttcgtggcggtgcagcaacactttattacccaatttggcacttagaagcagaaaacttgctcgtattaaaaaataaccgtggtgtagaagacaaccgtgttcgtcatatggattatggcgtgcaattaaacaaattaatgtatcaacgcttaattaaaggcagcgagattactttatttagtccatcagatgtacctggactttatgaagcattctttgcggatcaagacaaatttgaagaactttacgtaaaatacgaacaagatccaactatccgtaagcgtactgttaaagcagttgaaatcttttctttattaatgcaagaacgggcatcaacgggtcgaatttacattcaaaacgtggatcactgtaatacccactctccgtttgatccacaagttgcaccagttcgtcaatctaacttatgcttagaaattgcattaccaactaaaccgcttcagcacattaacgatgaaaatggggaaattgcactttgtacactttccgcctttaacttaggtaaaattgaaaacttagatgaattagaagaacttgcggatcttgctgttcgttctcttgatgccttattagactatcaagattatcctgttgtggcagcaaaacgtagctcacttgcacgccgttcactcggtattggggtcattaactatgcgtattaccttgcgaaaaatggtgttcgctattctgatggttcagccaacgatttaacacaccgtacttttgaagccattcaatattatttattgaaagcctctatgaacttagcaaaagagcaaggtgcgtgtgaatacttcaatgaaaccacttatgcaaaaggcattttaccgattgatacctataagaaagatttagattccttaacacaagagcctctacattatgattgggaaagtttacgtaaagatattcaagaatttggtttacgtaactcaacattaactgccttaatgccatcagaaacatcatcgcagatttccaatgcgactaatggtattgagccaccacgcggtcacgtaagtattaaagcatcaaaagatggtatcttaaaacaagttgtacctgaatatgaaaatttaatggataactatgaattactttgggatattccaagtaatgacggctacttacacttagtcggtattatgcaaaaattcgtggatcaagcgatctctgcaaacacaaactatgatccaaaacgttttgaagacggcaaagtaccaatgaaagtgttgttaaaagatttattaaccgcttacaaatacggtttaaaaaccctttactatcaaaatacccgcgacggtgccgaagatgttcaagaagatcttgatgacggctgtgctggtggtgcttgcaaaatttaaacgcccctattgtcttccccaacttatggggaagatagcacgacataacgaattaggatactttcctcagtctttgatagtttcccctgataaacagggaaagctaaataaatgataagttctatttaaaggataaataaaatggcatacaccactttttcccaaaataaaaacgatcaattaaaagaaccgatgttctttggtcaaaacgttaatgttgcgcgttacgatcaacaaaaatatgagacgtttgagaagctgattgaaaaacaactttcttttttctggcgtccagaagaagtagatgtatcgcaagaccgtatcgactacgcagcattgcctgaacacgaaaaacacatcttcatcagcaacttaaaatatcaaaccttattggattctattcaaggccgtagcccgaacgtggcattattgcctttagtgtcgattcctgaattagaaacttggattgagacgtggacattctctgaaaccatccactctcgctcttacacacatattattcgtaatattgtgaacgatccttctatcgtatttgatgacatcgtaactaacgaagaaatcatcaaacgcgcacaagatatttcatcttactacgatgatttaatccgtgatagccaactttatggcttatacggcgaaggcacttataccgtagatggcaaagaatgcgtcgtgactttacgtagtttgaaaaaacaactttatctttgcctaatgagcgtgaatgcacttgaagcaattcgtttctacgtttctttcgcttgttcatttgcttttgctgaacgtcgtttaatggaagggaatgcaaaaattattaaatttatcgcacgtgatgaagccttgcatttaacaggtacacagcatattttaaatattatggctgcaggtcaagacgatcctgaaatggcagaaattgcggaagaatgtaaacaagaagcctatgatttatttgttgcagcggcagaacaagaaaaagcttgggctgattatctatttaaagacggttctatgatcggcctcaacagagatattttagttcaatacgtagaatatattactaatatccgtatgcaagctgttggattgccactaccattccaaacacgttcaaatccaattccttggattaacgcttggttagtgtcagataacgtacaggttgcaccacaagaagtagaagtaagctcttatcttgtcggtcaaattgactcaaaagttgatacgaatgattttgacgatttttctctctaattaaaaacacataaaaaactaaccgcactttggaatattctttttaaatatttaaagtgcggttaattttttgttcattttaaaaggctttctaacacagaaagccttttatttcttagatttctaataacaatcttgttggatcttccaataattctttaatcgttaccaagaaaccaacagattcacggccgtcaattaggcgatgatcataagataaggcaagatacatcatcggacgaatcacaacttgaccattaagcgcaatcgggcgttctttaatagcgtgcattcctaaaatcgcactttgtggtggattgataattggagtggacataagagaaccgaacacgccaccatttgtaatagtaaaattgccgccagtaagatcttctactgttaatttgccatcacgacctttttcagctaatgctttaatttgtttttcgatctctgccatactgagcttatcgcaatcacgaagcactggtgtgactaatccacgtggtgttgaaactgcaatactaatatcaaaatagttatggtaaacaacatcatccccatcaatagaagcattaacttcaggataacgttttaatgcttccacaaccgctttaatataaaaagacataaatcctaaacgtactgaatgttgtttttcaaatttttcgccgtaggttttacgcagagtcattatcggctgcatatccacttcattgaaagtggtaagcatcgccgtactatttttggcttcaagtaaacgttcagcaatacgtttacgcaaacgggtcattggcacacgtttttcagaacgtgcgctataagccaccgtactaattgtattttgctcagtggcagcttcttgtttcacttgctgtgcttgtcgttttgcaatttcacgttcaatatcttcacgtgttaaacgaccacccacacccgaaccttgaatttgatctgcttgtaaatcatgttctgctaataaacgacgaattacagggctctgatccgcattatgattatgactattttcaatcgctgcattttgacgatcagatggtgtgggttcattcgttgcttttaacgtcgctgaactgacatctccttcttgagccgtagaaattttgcctagcaactgtttactcaccactgtttcgccctcagcttgaacaacttcagccagtacaccatcagaaagtgcgggaacttctagcacgactttatccgtttcaatttccacaataacctcatcacgtttcacagtatcgcccagttttttatgccaagtggcaacagttgcatctgcaactgattcaggtaggtctggaacaagaatttcgattgccattttatttttccttttcttcttttttactatatcttaattatcttggctcccctatttacagaggaaagcaaagataaaaacctttattaaattaaccgcactttaaaaactcaacgcatcttccactaactgtttttgctgtttagtgtgaagcgacatataacccacagcaggcgaagcagaagctggacgccctgcatatttgagtttaacggattctggaattgctgattcaaaattatgtttgctgcaataccaagccccttggttaagtggttcttcttggcaccatacataatccgtgacatgcgcataaggctcaagcgctttcttcacatcctcatgcgggaatggataaagctgctcaatacgaataatcgctacatctttctgattatttgcacgacgttgttcaagtaaatcgtaataaactttacctgaacacattaccacacgttttacatctttaggatcaagctcatcaatttctccgattaccgtttggaaagttccattaatcaactcgtctaaactggacactgccaatggatgacgtagtaaagattttggggaaatggcaatcaatggacggcgcattttacgtaaagactgacgacgcaacatgtgatacacctgtgcaggtgttgatggcacgcaaacttgcatattttgttctgcgcaaagttgcaaataacgttcaagacgtgcggaagaatgttcagggccttgtccctcatagccatgaggcaataacataactaaaccacacattctgccccatttttgttcgccagagctaataaattggtcgataacaatttgcgcaccattagcaaaatcgccaaattgcgcttcccaaatggttaacgtttttggatctgttgttgcgtagccatattcaaaagcaagaacagattcttcagaaagtaccgaatcccatacttcaaaacgaccttgattggcgtgtaaatgtgttaatggtacataccccgtaccatcattttgattatgcacaacggcatgacgatggaaaaaagtacctcgtcccgcatcttcgcctgataaacgaacattaacaccttcatcaagtaaggttgcataagccatggtttcagccataccccagtcgagcaatttttcgccttgatacattgctttacgatcattatagattttttctacgcgaggatgcgcacgtaaactttcaggatattcacatacacgtttagcaagggttaaaaaacgttcctgtgaaaatttgctttcataaggtgctgtccaatcataattgagatattgcaaccaatccatttttgccgtatccatttctcgccattctgatacgactcgatcgccattatctagcgcatcgcgataatcattcgccatctcggtaacttgttcttcagtcatcacaccttctgaaactaagcgatctgcataaactttacgaggtgtaggatgttttttgatgatgctatacatcattggttgagtggctaatggttcatctgcctcgttatgaccatgacggcgataagaaattaaatcgataaaaatatctcgtttgaataaattacgatattccaccgccatacgcgcagcaaatgccaccgcttcaggatcatcgccattaacatgaataatcggcgcttgaatcatttttgcaatatcggtgcaatattctgtagagcgcgtatcattaggattagatgtcgtaaaaccaatttggttattaatcacgatgcgaatagtaccgcccacactataaccacgggtatttgacatattcaatgtttcttgaacaaccccctgtcctgccacagctgaatctccgtggacagtaatagcaagcactttgctatgttccgtatcattcatacgagtttgtcgagatcgaacagaaccaatcacaacagggcttacgatttccaaatgggagggattaaatgccaacgttaagtgaactcgcttatcatctacggcgaaatcagaagaaaaaccttgatgatatttcacatcccccgtacgttcactggaatgtttacctgcaaattcatcgaataaattttcaggctttttacctaatacattcacgagcatattcaaacgcccacggtgtgccattcccattaccacatcatttaccccttgacgactagaatggcgaataatttctttcatcaanggaataaacgcatcacttccttctaaagaaaagcgtttcgccccagggaatttcgcaccaagataacgttctaaaccgtctgctgccgtaagttcacgaagaaaattgacacgttcttcagatgtaaaaagcggtttatctaacaggctttccatcttgctctggagccacattttctgctccatatcctgcacgtgcataaactccaagccaattgagccacaatatgtttctttcaacatttgagctaattcgccaagtttaatggtatcgcgtttataaacgtaatgatttatattgaaagtttcgttgagatcttgttcagtaaaaccgtgatggcgataatctaattcagggacgaaagatactttccaacgataataattgagaggatcaagattagcctctaaatggccacgaaaacgataggcattgataaattgtagaactttcaccaattttgcaccagctgcaggatctatcactgtcaccgcttcattatgattttctcgcgctaagcgacgaaaataatctcgcactggagtatggggctgttcaagtgcggtggtttttggcaaagaatcaaaggtttttcgccagctttcctccaccgactgtggatcactcaaatagctttcataaagttcttctatataagattgatttgcaccgcctaatgctgtgctggctaaccaatcatcaaacgccttgttttgctgcataattacctctttattatgatatttgaagcaatattttcgctccattttttacgcattatacataggattgcaacggaaataagcctcttatcggaaattgttacaaatttgtgatctagttcaaactctttagatttcaaacaataaaaaaccgcacttcatctcttaaacaaagtgcggttatttttacttgtattaaaatttaggatttagaatttaaaaatggattgctccgcttttcttgcccaatggttgtgtaagatccgtgtccagcgataataataatatcgtcatttaatgggagtaattttgttcgaattgaagaaatcaatgtttcataatccccgcgagggaaatcggtacgaccaattccgccttgaaataatacatcgcccgtaaacgccacttttttctcgtgttcaataaaaccgatatgtcctggtgtatgccctggtaaatgtaaaatctcgaaattaaagccatctaattttaaaatttcgccctcttgattaaaccaacgatcaggcaaaaaagcgtcaatatttggcaagccaaaacgttgtgcttgctcgggtaaactctcaaataaaaatttatctttttcattagaaccccaaatttcaacgccaaaatgttgttttaattgcatcgctgcgccaacatgatctaaatgaccatgggtaagcaaaagcactttaagatttaaatctagttcttcaatgcgttgaattaggcgttcggcttcgcacctgggtcaataattgcggcatttttttcatcatcccaaatcaaagaacaattttgttggaatgcggtaacggggataatttcgatattcatttttgctccttataatcgataaaactgttgagtattcaaaaggatttgcttttgaacagaatgtaatggcaaagactttaattcagctagtttctgcaatacagccaataattgttcagaaatgcccgcacgttcaaatccttcgtgttgccaagggctatccgtttcaatcatcaaacggtttaacgacaaatgttgagcaacatactgtgttttagagttccataaaatatcaggggttaggcttgcaaaatagggggtagagaaaaatttctgaaaagatttttcatctgtcttaaaccagtgaaaatgagcccgttgaatattatgtttctgcaataattcaagggcaatttctacatcgttatgtacaatatgcaaatttaacggtaaatcccattttttcgctatcagaataaatcgctccagtaattcaatgtaaggcacgtaatctaaattcggattttctcgtttagaataatgtggcaagcccacctcgccaatggcagaaatcgatgaatgatgttcgtcaatccattgaaataattttttttgttcttctaaactaggtaattgctgttcaggatgaaaaccggctgcaatataaagtttctttgggtaagtctgttttaaattcagcagttttttagcactgttgagattagtactcaccgcaagcatacctataatctttgaatgagcaagtgtttgctgaatattctcgtcagagagttggtctaaatgaagatggctgtcaaataacatttcttttccaatgaaaaaccgcacaaaagtgcggttaattttacatttgttttacacgcctttccaagttctcacagggcctgtatctacgtgaatgaaattactggttggataataacccacgccaccatttcgcagactttccgcagaagatttcactttaatcaaaggcacacccgcaatacgaaaatcaatggcttttcctttaatgtgataactatttttcgctacgcacgactttggcgacgacgcattgcattagtagaggctgaacgataaccacaaattacttcaatttcagcattgcgtaagcctaaattagtttggatattataaaatttctggaataaatttggatccattttatgcacttgatttgtccttttatcacgcattaaataatccaatttttttaacatcgcaggcgaaaaaccttttgctaaagaaaactcgccacttaatctttcgcccgtattaatgttgcggaaagttaaaatacgaggtttaggtgttgaaaccattgctaatacagaatttggtaaaatagatattcctaacgcaataccgcccagcgataaccattttcgtttattctgatccacataattcattatagctcccttattttattgaagatatttttttacgagatcccaattaatctcagcaagattaatctgacgatcataaccataaatatcaggtaaatttacaatatttccgttttcaatccacgcagtaacataatataaaaaaacaggattatccgagcgtatcggcgcagaagtggtttttttacttgctaatactgtattttttcgagtttctgtccaacctgcttcttttaataaaatacttgccaattgatcagatttttcaacacgcacacaaccagaacttaacgctcgatttttacgattaaacaatccgcgatttggcgtatcgtgtaaataaattgcatcagaacttggcatattaaatttataattacctaacgcactatcgccagccgcttgtcgaactcgataaggaaatttattatcaatagattcccaatcaatagaagcaggatcaacaacattgccttgattatctaaaattgaataattatgctccgtaatataatttggatcggctttcatttttggcaataaatcttcattaattaagcgaattggcgcattccaaggtggatttacaaccacattacttaatttgctatacattacaggtgtcctgcgcgaatttgtgccaacaattacccgagattctaaaattaaatcgccatcacgataatactgtaatttatagcttggaatattcacaaaaattccattatgaaaatcaggaatcacacgtaaacgctgtgcattcattgccaatttttgagtaatatttgattctttagaagtcggaataaacatcggcaatgattgaattgtttggcgatataaatgattttctcccgctaaactttgtatgaaatcaagaagttgattattttccaccgcacttaaccagcgttgaatatgatcattttcaggctgttgtgcttgatactgagcagatgaatacaaccaattagatgcttgagaacgaacattttgtgtgtaatataagtaatctaacaaaatatcacttaataacacatcataaaccaatccgccttgttgttctaccaatgccaatgtttctagtgaagttgccgacgattttgaaataccgcttgccaccattgccgcataatcacgtaacaattgacgagctgccgcattgtcagtccataacggggcatatttacgagaagcatataaacgcgcgagtaaaggcttaaattgtaacttatgatcgcctatttcgtgtgttagcgtcatattaagcaatgtttgtttttcttccgttaaacgttgctgatccgcataaatggcttcttcaagctcttttctttctgcgagtgacaaatgggaaagattaatgccgtacaatgatttagattggtcatttttgctcaaacctactaaaacacaacccgacatcatcatagataatgataaggcgaataatgataactttaaggtgcttttaaacactaccatttcctaaacctttattaaaatcaccgcacttgttgcttttctcaaacaaagtgcggtcaaaaccatttagtatttattttttactttccgtttttgcttcggataggccgtttgcttgattaattttctgatctgaattaaaaataacgaaatcagctgctattttttcagcttcttttaagaagaaatctggtgcttcgtaatctttcggcaaatcatcaatatctttcaatgctttcttaccctcacgtttaaaacgttcgttcaaatcttttaaacgtcttgcatcatctttatcattctctgctttacgcattttataattcaatgatagaaattttcgatctcggcgttcatttcgcactttcaattcttcattcaatgcaacaaattcaggatctttagcaatacgagcaagatgtttttcatttagaatatttactgcattatcaatataattgatatttcctacttccatataactcgctgatgggattttatcccaagcaagcgcattatcttctttatcttccccatattctttcgcatctataatttcaggaaaattaatatcggctgcaacaccttttaattgggttgaaccaccattaacgcgataaaatttttgaatagtatattgcaaaacacccaacggactctgatctaaatcatagataaaatttaacgaacgactctgttgcaccgtacctttaccaaaagtattttgcccgatgataatacctcgacgataatcttgcattgctgcagcaaaaatttctgatgcggaagcactgtaacgattaatcatcacaaataataaccccttatattgttgcgtagcatcatcatcttcatgaacacgaatacgctgataagcatcgcgaacctgcacaacagggccatcggtaataaataaaccacttaacgccaccgcttccgttaatgcaccaccgccattttcacgtaaatcaacaataagagcctcagctttttgattttctaatttaaccagtagttttttgacatcttcggttaatccaatataaaaacttggaatttttattaccgcaatgttttttcctgacactttttcaaaggttagtttagccgcttgatcttcaatacggactttatcacgaaccaaagtaataatacgtgattttccccctttagcaggctcaatttctaagcgaactttagtgccttttttccctttaattttttctaccaaatcttctaaacgccaaccaacaacgtcttcaatatcgcctgttgcttgcccaacaccaatgattttatccccaggatgcagctttttactacgttccgctggcgcaccaggtacaagagatttgatgctaatttcatcatcttctgattgtaaagtagtcccaatgccttccaaagaaagatttatactttcattaaaactttttgctgttcttggggaaagataactggtgtgaggatcaatttcacgcgcaaaagcattcaaataaatttgaacaatatcgtctgcttttgtttgcgttaaacgacgaatggctaaattatagcgttttgtaagctttgctttgatttctgaccattttttatcttttaatttaagattaataatgtcattttttacacgagcatcccaaagtttatttgcatcagcttcagtttgtgcgcagccgctttttcacgatcaatttcaatttgatcttgaccatttaaatcaggctctttatctaataaagataacgcataagtataacgttcatagcgacgtttcatcattacatcataaatgtcaaacgctgcagaaagatcgccttgattcaactgttcatctaacttagtaccatatttttgacgaagttcgtctatatcagactgcaaaaaagtattgtggttaaaatctaaatttttaatataacgatcaaaaattttctcggaaaaatcatcatctaatttaatcttacgataatgggattgagttaatcttgtcgttgcacgcttagttgccaactggctttcttcacttatcgctggaatactaatgtcacttggttttaatgtaggttgtacagcaaatgcaggaattgcactgctcaaacacaccgataaccacgtataacaaatcacattttttgacattttaaatttcataaccatttccgagtcaatttttatttattaagcaaataaacgatctgcagcaacgttcataatcaaaccgttttcaagttcaacacgtgctgaatcttttaatacttctaccactgttgcttttttagcattatctccagctttaactttcacaacagaaccaacagaaatttgtgaaaaatcaaccgcacttagtgataatttactctcttttttaaggtttttattcgcaggtttacgcggatgctttttttgttgtgcttttttagctgcagcttctgcttacgtttttccgcaaaacgcgctttcgcttcagcaagttgctgtgcagcgtgagcaacgtgttctgcatctaatacacccgcaggattaccctgtaaatcaacacgcactgcaccttcacgacagccatataaataacgccaatttgatgtgtattggcgaagagcctgacgcaattgggttttacttacgcgttcatcatcttgtaatgcttcagctaaatcttgaaataaacctatttttaatggttttgcttcgccctctaaaacaaagcaaagaggaaatttttctgctaaataagtaatgatagcttttgcgttggttaatttttgcacttccgtttgcacatctgtaacttgagatgataattgtgtgtcagtcatagttatatccttgaggcattaataaaataaagatttgcctagtttatcgcactttttacaaaattaacaacggatcccgttatgctgaataaatttcacacaaaaataacgccaagacttcacaaatacgttaaaacaacgatagaatggcacgtttttgatttataaagaaagaccacaagcgtgcctaaaacaaagctaacttcgcctccatttaaaattttaaaatgcacagaatgtgatgcttgcattaacgtgccttctattcttcaatcaaatgaacaagccgaatgcccacgttgtcatcatctattagcaagtggtacgaggtggtcattacatcgttgtgcaatgattgcattatctattttgatattaatgcccttttccttgaactaccccttattaagtttacatttattgggtattaaaattgatgcctctatttgggatggcatttggaaaatggcagtaggtggttatgaatacacagcgtttatgatctttatttgtgcagtagtaatgccgattacgtttgcacttttagtgattatgctttggctggctaagatttttcagataaaacctcgtagtgttttactatttcttggttacattaaagcttgggtaatgtttgatgtttatttagtggcactcggagtaaccatatttaaagtacgcgaatatgcaacattagaaattaatatttatttaattccttttatttttaccgcacttttaactacgctgctttttatcaaacttaatctttccgccttatggcaggaattttatcctgaatgcacttcagtttatacaaaacaagctgttgaattatgtcctgcttgccattacacattcacgcaaaaatctatccattacgatcatcaacaaaaaatttgttgtccccgctgccaatcgcctcttaatacatcggataagctaaaattacaagcaacttgggcaaccttaattgcagggattattatgctttttcctgcaaatttattacctatatctggcatttatttaacaggcgcattatctgaagatactttaatttctggggttatttcatttgttaaatcaggtagttattttgttgcttttgttgtattttttgccagtattttcgtgcctatcagcaaaatttttattatgctttacttacttgcttgcgtgcattttaaatggcaacattctattaaatggcaaatgcgtttattgcatctagtacattttgttggacgctggtctatgcttgatttatttgtattagccttaatgatgtcgcttgtcacacgcggagaaatcattaattttaccgtagggccaggcgcattttattttggtgcagccgtattttgcactatgctttccacctcacaatttgatagcaaattaatttggaaaatttatgacagagaaaaataattcctcctcaatagaagaaaaatatcaagaaagaacagcgaacttacgtaaaacaaaacgcatttcgcctttttggctattgccttttatcgcattatgtatcggggcaattttattcttccaaattgtgaaagaacgcggtactagcattacgattacctttaccaatggttcaggtatcgttgcggataaaactcaaattcgttatcaaggattacaaattggcatagtaaaagaagttcatttcactgataacctacaaaaagtggaagttgtagccaatatcaatcctgaagcatcaagtattttgcgtgaaaatacaaaattttggcttgtgcaaccaaatgtttctcttgctggcatttcaggattagattctctcgtgtcaggtaattacattactcttcaaccaggtgatggcgatcgtgaagatgaatttatagcagaagaacaaggccctattgcgcaagtttccgcaggagatttattaattcacttaatttctgatgatttaggttcgatttctattggtgcgtctgtgtattttaaaaaattacctgtaggaaaaatctatgattaccgtattaataaaaacaataaagtagaaatagatgtggtcattgataaagcctatgccaagtttgtgaaaaaagattcacgcttttggaatattagtggcattaatgcgaacattagcccatcaggcttaaacctaaatgtagaaagtttaaatgccgttgtacagggggcggtttcttttgactctccagctgacagcccaaaagcagatgaaaatagtcatttcacgctctataccaatttaaaagcggctaaacgtgggattgaaattaaggtaacaattcctgcctcatccgctcttattgcagggcaaacggaagtttattctcaagataatgctatagggattctcgccaagctaagtgcggtagaaaataacgatgaaattttagaaggcagtttattgatagatccaaaccaagcttctttgtttaaagcgaatagcaaaattgtcctacgcaataaaaaaatagatcttggcaatttagcagaaccaaaaaaattctttcgtggcgaatattttgatgtgattgcgggagacggcgaaactaaacatcaatttaacgtgattaaagaaaatgaattattactcaatgcgcctaacacgttagttttaacccttactgcgccagaaaattatggtgtaagcgaagggcaaaatgtgttttataacaatatgataattgggcaaattgtttcacaaacaatagatgtaaatggcgtacaatttaaagcagcaattgcctctgaataccgcaatttaattcacgaaaatacacaatttgtggcagcaaccaattttgatataagcgttggattagatggattgcgttttgaatccgcgacgccagaaaaatggttacaaggcggcgtaagagtattaacgaaacaaggtctggggaaagctaaagatagctatccgctttatcaaaatatcagcaatgctgaacatggcatcacaggaaatattcttacgccaacgataaccttacacacccaaaccttaccaagcattgataaaggctctcttgtactatatcgtcaatttgaagtaggaaaaattttaagtattaaacctaaaacaaataactttgatgtagacatttatatttatcctgcttatcaacatttattgacagataaaagccgtttttgggtagaaagtgcggcaaaaatagatgtaagtccaaaaggcattagtattcaagcaacgccacttgcacgttccttaaaaggggcgattagctttgataatggcggttcaggcaataatcgaacactttatgcaaatgaaagttatgcaaaatccattgggtttgtaattacgttaatcacagatgatgcaactaatcttagcaaaggaatgaatctgcgctatcttggtttagatgtggggcaaattgacagtattcagcttgatgcaaaagcaaaacgcattactgcaaaagccctaataaatccaaattatatgaatataattgcaaaagaaggggctaattttacgataatctcgccacaaatttcggctggtggaatagataaccttgatagtttattacagccttatattgatattgaaattggtaatggaaacacaaaaacacaatttaatttagcacaaacggcaccacaacgtaataaatttagcaatggcacgccgtttattttagaaacgcgtgatgcgatgaatttaagtgaaggttcgccaattctttatcgaggtgtagaagttggcacagtgaagaaatttgaacttaatagtcttggtgatcgtgtgttagtgcatattgccattatgccgaaatatagccatcttgttcgacaaaacacagaattttggatcgcatcaggctacgactttagcttaggctggaaaggtgcggtatttaatacgggtagcgttcagcagttgctaaaaggtgggatttctttctccacaccagcagaaaaagaaattcaaccgcaagcgcagcccaacaaacgtttcttgcttcaaataaaccgccctgaagaagtgcaaacttggggaagtggcgcgttatcaaaataacataaatgaaaatatttaatctgcaccttaatgaattagggtgcagataagctattaccatttttctaatgcttctttatcactctctcttgcttcaatccaacgctcgccttgattggtttgttcttttttccaaaatggtgctttagattttaaaaaatccataatgaattcattggcgtgataagcatctccacgatgtgcggaacttacccccactaaaacaatttcatcgccagtttgtaaaagcccaacacgatgaattaccgatacacgttgaatatcccaacgcactttcgcttgtgcaacaatttcattcaacgctttttcagtcattgcgggataatgttctaagtataaactggatacctcatcgcctaaattaagatcgcgtactttacccacaaaaataaccgttgcgccaattgaatgttgctcagaaagccattggtaaacggcattttgatcaaaaggctgttcttgtaccgcaatttgaatatccgtcatttagccccctgttactggtgggaaaaaggcaatttcatcgccattttttaccgcactttctaaaggcattaaggtttgattaattgccactaaaagtttacctttttccagtgccaatgcccatttatcgcccttttgagcaaggtgttcacgcaccgcttccgcagtggcaaaatcatcttctaattgaatggcatcaacgccaattaattcacgagtttgagcaaaaaataaaacatttaacatcttatttttcctccgcaataaaatggcctgattttccaccgctcttttctaacaggcgaacgtgctcaatcactatgtctttttgtacggctttacacatatcgtaaatggttaaggctgctacgcttgccgcagttagtgcttccatttctacgccagtttttccagttaatttgcaaagagattgaatgcgaacttggttggtttcgagtaacggttctaaattcacttctactttagaaagtaacaatggatggcaaagtgggataagctcccaagtgcgttttgcggcttgaatacccgcaatacgagcagtagcaaatacatcgcctttgtgatgtttaccttccacgatcatggaaagggtttcttttgacatagttacaatggcttcagcacgagcttcacgaacagtttccgctttagcagaaacatccaccatattggcttcgccttgagaattgatatgtgtaaatgtagtcataatataataaaagtgcggttaaaatattgaatgttttaaataagcgacaaaaggaagcagatgaatattaccattcatctcactttgctttttagccaccaatagaagctaaatgatttcttacaccagtatcgccgatatgcaaataatgatgttcacgtttgccttgaagtgcggcaaaaatacgagcctgtaaaataccttgctgttcgtgcgactgcaataaatcacgtaattcaatgccttcttcgccaaataaacaaagatgaagtttaccttttgctgacactcttaaacgattgcaacttgcgcaaaaattcttttcataaggcataattaaaccaatttcgcctgcataatcaggatgcgtgaatactttagcaggaccatcagtatgggatttgtgttgtaatgtccaaccatttttcaacaatttatccgctaagacttgtccagaaagatggaatttatcaaagaaactatccatttcgcccgtttgcatgagttcgataaagcgcatttgaattgggcgatctttaacccaagcgagaaattgttcaaattctttatcattcagatttttcattaaaactgaattgactttaactttgttgtagcccacttcaaatgcacgatcgataccacgcatcacgtcatcaaatttattgatacctgtaatttgatggaacattttgggatcaagactatcaacactgacgttaatagacgtaatccctgctttcttccaatcagccacatcttttgccatgcgatagccgtttgtcgtgacggctaattgacgaatgccatcaatgttagtaatgctttcagcaatagaaataaaatctttgcgtaaagtcggttcgccacccgttaaacggattttctctgtgcccatttcagcaaaggcttgagcaagatgggtaatttcttttaaagttaagaaacttggtttgttagcttcgggttgataaccatcaggtaaacaataagtacaacgaaaattacactgatcggtaatcgacagccgtagatagtaatattgacgttggaaaggatcgactaagcgagactctcctacgtttttaataggaatggattgcattttacacctttctaaatacggagaggataaaccgtttccagcgtatccctgaataacgtagcgcgttattggcttgccaccgtatttctatgaaacttaggctaaacaagctcggagttatgcgttaaatttgatttttcgtcattctaaaagatttcactccataaacacaatcaataatattgatgaaaatcagtattttcctaaattcttaaaaatcaattatataaaaaaatacataatgaatataagactagctcattagtgataattaatcctatttatattaataaccataaatttttagctgattattatgaggnatttttattgatttaaatcataatttaatcaataaataaatttctctacttttcataatcagaaaaatatcctactatttttatcggatttatttttacttaatcaatataggagtgatttatgtcttttgcccaacaaaaacttagcgaactcgctgtttcaattccaggtgcaactaaaatttttcgtgaatatgatttagatttttgctgcggaggttctgtattattagaagtcgcagcacaacaaaagaatcttaaccttgctgaaattgaaaaacgtttaactgatttacaacaaagtaaagcagaaaataatgataaagattggacttcggcatcttatgcggagatgatcgatcacattattactcgttttcataatcgccaccgtgaacaactccctgaattaattacattggcggagaaagtagaaaatatacatggtgatcgtgatgactgtcctataggcgtagtcgcacagttagaaaaaatttatgctgaacttagccagcatttaatgaaagaagaacaaattttgttcccaatgatcaaaatggggaattatgctatggcctcaatgccaattcgtgtaatggaaatggaacacgatgaagcaggacaagatgtggaagtgatcaaatcgcttactaataactgcacgccaccagcagatgcttgtttcagttggaaagccttatatagcggtattaatgaatttattgatgatttaatgcatcatattcatttggaaaataatattttatttccacgtgtattaaacgaaaaataatttaatattcgtcaaaaaataaccgcactttaatctattccgaaaaacaaactaaagtgcggtcatttttacaagcgttttgagttggtcgataagccgagttctgtcgtggacaatcattcctctaggcgacaaattactctgccgctcaagcaacctacccgaactctggacgggccacccattgagttcctatttggtcttgctacgagtggagtttaccctgctgcacgttgttaccaacggcacggtgcgctcttaccgcaccctttcacccttaccgtttacacggcggtctgctctctgttgcactggtcgtcggctcacgccgcccggacgttatccggcactctgccctgtgtagctcggactttcctctcgtttacttgtcccactaggtcgtataaatacggttaagggcttcaataaaccagcgattgtctaaccaactcggcgcgtagtataggggcaatcactagtgcggtcaataaaatccccaatttttgaatattgcttcatcaatcttatcaacaataatgcctaatttttcattcgtatttttttatgattccgctaaaataacgccaatttcaaccgctcttttaggaagaagaatgaactatctaaaaattgcacaggattccctttcagtggaaagtaacgcacttttgcaactcagccaacgcttaggcgacgattttaatcaagtcatcgatcttattttagcctgcgaagggcgtttggtaatcggagggatcggaaaatcgggtttaatcggcaaaaaaatggtagctacctttgcctctacgggtacaccaagtttctttttacatccaacagaagccttccacggcgatttaggtatgttaaaaccaattgatatcgtgatgttaatttcctatagcggtgaaaccgatgatgtcaataaactgattccaagtttaaaaaatttcggtaataaaattattgctgtgacgagtaacaaaaattccacgctcgcacgccatgcagattatgttctagatataactgttgagcgtgaagtctgtccaaataatcttgcgccaaccacttccgcacttgtcacactagcccttggcgatgcacttgccgtatcgcttattacggcacgcaatttccaaccagctgactttgccaaattccatccaggtggcagtcttggtcgtcgtttattatgtaaagtgaaagatcaaatgcaaactcgcctaccaacaattttacccaccaccaattttactgactgcctcacagtcatgaatgaagggcgaatgggcgttgccttagtgatggaaaatgagcaacttaaaggtattatcacggatggcgatattcgccgcgcgcttacagccaatggtgcaggaacgctgaataaaacagccaaagactttatgacaagttcaccaaaaactattcatcaagacgaatttttatcaaaagccgaagactttatgaaagcgaaaaaaattcactcgctagtcgttgttaatgatgaaaatcacgtagtgggtttagtggaattttcaagctaaggaatcccgatgcaacaaaaattagaaaatattaaatttgtcattactgatgtagacggcgtactcactgatggacaacttcattatgatgccaatggtgaagccatcaaaagctttcatgtacgagatggtttaggcataaaaatgctgatggatgcggatattcaagtggcagtgctttctggtcgcgactcccctattttacgtcgtcgcattgccgatcttggtattaaattattctttcttggcaaacttgaaaaagaaacggcttgttttgatctcatgaaacaagctggcgtcaccgccgagcaaaccgcttatattggcgatgatagcgtagatctccccgcctttgcagcgtgtggaacttcttttgctgtggctgatgcccctatttatgtgaaaaatgctgttgatcatgtactttccacccatggcggcaaaggcgcattccgtgaaatgtccgatatgattttacaggcacagggaaaatcttctgtgtttgataccgcccaaggtttcctaaaatcagtgaaaagtatggggcagtaataactcattcgtcaatgttattgcctaataaaaaataaagtgcggtcaattttcaaagcgttttaaaatctctcaaaaatcaaccgcacttttatatttataacgctcccgcactctgacagtttatctctttcttaaaatacccataaaattgtggcaatagttgggtaatcaaattcaattgttgatacggcaaactaaagacggcgcgttcttctgcggtcatctcttgtttttccaattcttttaaatgtgtttcgatactttcttgctgttggttaaaaatagcctcaggtatttcttcaatatgttctaaggtataaataattttctttgccacaggataaaaaccagataaaaactgtgcggtctgttgcaaatttttcattctgtcgcgataagctcccagtgctgaaatatagcttaatagagaataattaagtttgagcaaatcaaaacctttctgtaaatatgccttatatttcactggctcattattcatattagaaagcgttgtactcagtgcggctgcatattgatgcgcattgcgacgtgctatgcgatatttaagatcgtcacttttaccaaattgcaattggctaataatatgcaataaatacaccgcatcactacgcaatgcttgatggctcactttatcaagttgcaaatatttccaatctggccataagtaagatacggcaaaccatgaaatcgcggcaccaagtaatgtatcaagtaaacgaggcattaaggcggctgccgtatcaaatcccatgacatcaaaactgagcaatacttgcagtgtgatgaaaaaggtcgagaaactgtaattattactacgaaagaaaaagaacaacgtgcttgtaagcaccacaagacccagttttaattctaaggttggatttaaataaggtaatagagaccccaccactacgcctaatatcgtgccgataatgcgctgacgtaaacgtactttagttgcagaataatttggctgacacacaaatacagtggtcaataaaatccaataaccaagattaaattggaaaaactcaacaattgcacagcacaaaaataccacaatagataagcgtactgcatgacggaacaacggtgactcaaaagtaaaatggctaaaaatcaccgcactgatattttttaacccagtgatttgttccgtatgaatttgagctaattgttctgtaaccgtcgtgtcttgtgctaactggcgaagttgccagttaatactttgtaaattatctaacaaggtttgaatatcaatcagttcatcttgatcattaagatgttgtgctcgatatagatcaaaggaatgcaaggtgcctaaaagcgcacgttcgacacgtttattaaaatgatagggtttattttcacgcaaactcgccgtaatttctttacaggattgtgcttgtagttctaacaaacgttgaatacggaaaatcaaatctgtattttttagtttttccgttatttgttgataatcaaaatgcgtagaattggcgcgctcatgaatgtcttgtgcggcaaaatagtaacgtaacattctctgagtaagaggatggcgatgttgccctctaatgcgataaaaaagcgcggtgcgaacaatattaaatgccgtgacaacattcgcatttttcatcgcgaaattaagatgttttttttcaatctcagccacttcgtcaggatcaaaaaaacaggatttggtatctaaatattcgcccaacgcacaaaacgctttagcgacactttcttgcacggggcgatttgggaaaaacaggtaaacaatcagagtcaccacgctatacagcaaggtaccgcataaaatcattacagggttaataaaccatacatttacctctgggatataagttaatgtggtgtaaagcgcaaccactaatgaaccgaaagcaatggtgctataacgctgccccacggcaccaatcatagtgaaaataaatgtcagcaccgtcattaacacaatatattggataggcttgccaatatgtaactgcacaataaaggaagaaatagaaaaggcaataagggtaaaaaatacgtttttcaatcgtccagttaaacggttatccaaatccaccaaaccacctgcaataatccctagaatcaaaggcattgattgcgaagaaatatcaaaaaaccatattcccactgccgcaatatttacggcaataaaaacaggaattgtagaaattactttagcatttaaccgaatattcatttcaaatccttatcaaaatagaaaagtgagcaacaaggctcactttttattgtataaagtgcggtcattatttatgggattttgcccagtttaagaaacgtgtttgagtttctttatccgcttgttggaaccaatattgaagctgttgctctgcaacgttttcgccctgaacaaccacttttcctttattcgcttttgcattacctgctggcgcaacagccactgaactcgcaactgttgttgcagcaaatttagaaactgatgccgctgcaccagacgcattatattcagcaagatcatttagcacattaccacttgggaataaaccttcttgttttaacacatccactttcgctgaaatagcattacctgattttgttttcacagtaatatttggcatttgattgaatttatcgccactatcaagattacgaataactggtgcggaaataactaaatcttcagcattaccttgaaatgtcacaatcacaggattagattcaaaaagagattgattcgatcctgaaccaacaatttcatttaaacgcacaacaacctgatggttttgggtatcatctacagtaaatgtcttagcttttccgagagatttagaggctttttgaccatcaatcgctaaaaactcaaggttagatgacgtagaaaccattccagcaaaggttgccgtacttgtgcataatgtggcaagacctaatacaacagcgcgtaatttcataattgctcctttggtataaatgaaatactcgcttatgctatgccaaattagccaaaatgaaaataaaaagtaagaattaatttaaaattttttgttataaatagcacaaacaatcacaatgttttattatgttggcgatctacacactaaaccagtgtcgtgaaaatttaatccattaaatatcaacgggagtaacaatgttgaacgatattttaacaggctatggaatttttattttggaaattttaacaattttattactcattcttgctgttgttggtttgattatttcttatcgccaacataacaagtctaaagtgggagaattagaaattaaagatttatcagaagaatttaatgaacaagttcgtttattacgtgattttaatctttctgaagaagaacaaaaacaacgcactaaagctgaaaaaaaagcggaaaaacaaaatgctaaaaaacgcaaagaaaaattgaaaaaaggcgagactttagaagatgaaaagaaagcttgcgtatatgtattagatttttgcggcgatatttcagcctcagaaacaaccgcacttcgagaagaaatttcagctatcttaaatgtcgccaaatctgaagatgaagtattactacgtttagaaagtcctggtggcattgtgcataattatggatttgcagcctctcaattgtctcgcttaaaacaaaaaggcataaaattaactgttgccgttgataaagtggctgcaagtggcggttatatgatggcttgcgttgccgataaaattgtatccgcaccttttgctgttattggttctattggcgttgtcgctcaaattccaaatgttcatcgactattgaaaaaacacgatgtcgatgtagatgtaatgactgcgggcgaatttaaacgtacagtgaccgtattgggtgagaacactgaaaaaggaaaacaaaaatttcaacaagaattggaagaaacacataaattattcaaacaatttgtctcacaaaatcgcccttgcctagatattgataaaattgcaacaggcgaacattggtttggacaacaagccattgcattacaacttgtagatgaaatctcaacgagtgatgatttaattttggaaaaaatgaaagaaaaacaggtacttaatgttaaataccgtttaaaaaaatccctaataaaaaaattcggacgacaagctgaagaaagtgcaattaatatcattcatcgttatagtacaaaacagtctagagactttatgtactaaacatttacccacaaaaaagaagtttttatttctatgtttacaagncaaatctttgtcattaagatactcgccgatctttaggggttttattatatttaattcataaatcaagttgagtattgttaatccaaatattgcgcagctaatcgtttaaatgattagctgcgttttttattttaataacaaaatcgcaacttaccatttccccttagcaaaattttctattgttcttgcttccataaatagggataataacgcccctattcaaaaggcaaaaaataatgacgcactatattttattgattatcggcaccgcattaattaacaattttgtattggtaaaattcttaggtctttgcccttttatgggtgtatccaaaaaaattgaaacggctgtgggaatgggattagcaacaatgtttgttttaactgttgcttccctttgtgcatatttggtcgatcactatattctaattcccttaaatgccacttttttacgtacattagtgtttattttagttattgctgtagtggtgcaatttaccgaaatggcaataaacaaaacaagtccaacattatatcgtttactcggcattttcttgcctttgataactacaaactgcgcagtacttggtgtcgcattattaaatgtaaatctcgctcataatttaacaggagtctgtcgtttatggttttggtgcatctctcggcttttccttagtattggtactttttgccgcgcttcgtgaacgtttagtcgccgctgatatacctgccacttttcgcggttcatccattgctttaattaccgcaggcttaatgtccctcgcttttatgggatttacaggacttgtaaaataataaaatgatttaccttttaatgataataactctgttaattttatttattgggttctctcagtatttttcaggaaaaagaaagaaataatgacctttttattcatcgtaattacgctactcgctttaattttcggtgcgattttgggctttgcatcaatcaagctcaaagtggaagctgawcctgtcgtagagaaaattgatgctattttaccgcaaagccaatgtgggcaatgtggttatcctggttgtaagccttatgctgaagccatttgcaatggcgatgaaatcacaaaatgtattccaggtggtcaaacaactatcgtaaaaattgccgaaattttaggggttgatgtaccaacaatggagggcatagaagaacctatcgagaaagttgcttttattgatgaaaatatgtgtattggctgcacaaaatgtatccaagcctgtcccgttgatgccattattggtacaaataaagcaatgcacacgattattcccgatctttgtacaggttgcgagctttgtgttgcgccctgcccgacagattgtattttaatgattcccgtgaaaaaaaatattgataattgggattggaaatttgatgcaaaactcgttattccagtaatgaatgtcgatggctctgaaaaaaaattggttgtgggggaataaatggcggacgtattatctcgtttcaattccggtaaattatgggatttcaaaggtggcattcatccaccagaaatgaaatctcaatctaattcacagccattacgccatctgcctctcggcacggatttttacattccactcaaacagcacctaggaacaacaggcaatcttttaataaaagagggcgattacgtcttaaaaggacaagccttaacaaaaggcgatggcttgcgtatgttgccagttcacgcgcccacttctggcacaattaaatcgattaaaccttatgttgccacgcatccttcaggtcttgatgaacccacaattcatttacaggcggatggtttagatcaatggatcgaacgtaatcctattgatgatttttcaacgctatcgtcagaacaacttattcacaaaatctatcaagcaggtatagcaggtttaggcggtgcagtattcccaactgctgccaaaattcagtcagcagagcaaaaagtcaaactcttaattatcaatggtgcagaatgtgagccttatatcacttgtgatgatcgtcttatgcgtgaacgtgctgatgaaatcataaaaggcattcgtattttacgttatatattgcaccctgaaaaagttgtcattgccattgaagataacaaaccagaagccatatcggcaatccgcaatgcactacagggagcaaatgatattagcattcgggttattccaacaaaatatccttcaggtgctaccaaacaactgatttatttgctcacagggatagaagtgccaagtggtgagcgttcatccagcattggcgtattaatgcaaaatgtgggaacaatgttcgcaataaaaagagcaattataaatgacgagcctttaattgagcgtgttgtcacccttactggaaataaaatcgctgaaaaaggcaattattgggtgcgtcttggcacacccatttcccaaatattgagcgatgcgggctatcaatttgacaagcattttcctatatttgcaggtgggccaatgatggggctagagcttccaaacctaaatgcacctgtgacaaaacttgtcaattgtttacttgcgccagattatcttgaatatgccgaacctgaagcagaacaggcttgtattcgttgttctagctgttctgatgcctgcccagtaaatttaatgccacaacaactttattggtttgcgcgcagtgaagatcacaaaaaatcggaagaatacgctctcaaagattgtattgaatgtggaatttgcgcatacgtatgcccaagccatattcctctaattcaatatttccgccaagaaaaagctaaaatctggcaaataaaagaaaaacaaaagaaatcagatgaagccaaaattcgctttgaagcaaaacaagcacggatggaacgtgaagaacaagagcgtaaagcgcgttcacaacgtgcagcacaggctcgccgtgaagaattagcacaaactaaaggggaagatccagtcaaggcggcactcgaacgcttgaaagcgaaaaaagccaatgaaacagaatcaacgcagattaaaacactaacctcagaaaaaggagaagttttacctgataacacagatttaatggcacaacgtaaggcacgccgtttagctcgtcagcaagcagcatctcaagtcgaaaatcaagaacaacaaactcagccaaccaatgcgaaaaaagcagcagttgcagccgcacttgctcgtgcaaaagcaaaaaaacttgcacaagcaaatagcaccagcgaagctatttcaaactctcaaaccgcagaaaatcaagtagaaaaaacaaaaagtgcggtagaaaaaacacaagaaaattcaaccgcacttgatcctaaaaaagcagccgtagccgccgccattgctcgagcaaaggcaaaaaaacttgcacaaacaaatagcaccagcgaagctatttcaaactctcaaaccgcagaaaatgaagtagaaaaaacaaaaagtgcggtagaaaaaacagaagaaaattcaaccgcacttgatgcgaaaaaagcagccatagccgccgccattgctcgggcgaaagcaaaaaaacttgcacaagcaaatagcgccagcgaagctatttcaaactctcaaaccgcagaaaatgaagtagaaaaaacaaaaagtgcggtagaaaaaacacaacaaaattcaaccgcacttgaccctaaaaaagcagccgtagccgccgccattgctcgggcaaaagcaaaaaaacttgcgcaagcaaatagcaccagcgaagctatttcaaactctcaaaccgcagaaaatgaagtagaaaaaacaaaaagtgcggtagaaaaaacacaagaaaattcaaccgcacttgaccctaaaaaagcagccgtagccgccgccattgctcgggcaaaagcgaagaaactggcaaaaacacaagcaacattagaaaataatcaggaataaaataatgtttaaaatggttagctccccacatactcattcaggaaaactcacagcgcatattatgctttgggccattttggcaatgatgcccgcttttttcacgcaaatttattattttggatttggcgtggtgcttcaatccgcattagccattggtacggcaatcattgcggaatttattgcaataaaattacgaggtaaaaaaccgctcaattatctttcagatttcagcgtagccctgactgcgttaattttggcaatggctattccaccttatgcaccttattggattatcatcattggaacactctgtgcagttttattaggtaaacaggtttatggggggttagggcaaaatccattcaatcccgcgatgattggctatgtaattcttctaatttcattcccattacaaatgacaacttggatgccaccaattaatttattacaggaaccaccgactttttcagatgcattttcattaatattttcaggtttaaccactgatggatttacgctttcacaacttacgcataacattgatggtatcacccaagcaacgcctttggatagtgcaaaaattttctataaaagtcacactcaattaaatgatttttatgagctaattaaactacctatatttatgggtaatggaactgatttcgctcaaggatggtggcaaatcaacgtggctttcttagcgggcggaattttccttattttaaaacgtgtcattcactggcaaattccagtggcgatgcttgtcacctttttctgtttagccactgcgaccgcttttactggcttcacgcatttaagtgcgattagccaactcgttagtggcgcaatgatgtttggtgcattttttattgcaacagatcctgtcacagcctccattacaccacgcggaaaaattatttttggcgcattagtggggttatttgtttatctcattcgttatcacggaaattatccagacggcgtggcattcgccattttattaagtaatatttgcgtcccacttatcgatcattacacacgtccgcgcgtatctggttatccaacaaaaggaagaaaataatgggtacagtaaaaatcacatcgcgttatggcatattgttaggctttattgccctactttgcacaataatttctgcaggaattttcttcctaacaaaagataaaattgatgcggtaatcgcagcacaacagcgagaattacttctacaagttatcccacaagattatttcaacaataatttgctagaaagtgcggttattccccaagataaaaattttgtgggtatccaaaaaatttattttgcgaaaaaagatggaaatgtttctgcctatgcctatgaaaccaccgcgccagatggttactctggtgatattcgcttgcttgtgggattagatccgaaaggcgaagtgttaggcgtacgagtaatcgaacatcacgaaacaccaggcttaggcgataaaattgaacgccgaatttctaactggattttaggtttcacaaatcaatcgattaatgaacataatttaagcgaatgggcggtaaaaaaagatggcggaaaatttgatcaattttctggtgcaaccattacacctcgcgcagtggttaatcaaactaaacgatcagcattaatcatgctaaataatcaagccttgttacaacagctttcaacacaagtgaaataatatgacagatttaactgaaaaaaataccgcacttgaagaagaaaaaatagaaagtgcggttgaaaatcaacaaaaatccatctggaaagaaatttttgctcaaggaatttggaaaaataatcctgcggttgtccaacttctcgggctctgtccgctgttagcggtgtctagcaccgccaccaatgcacttggtttaggtttagcgacaatgcttgtactcacttgcacaaatacggtcatttcccttttccgtcaatatattcctaaggaaatccgtattccaatctacgtaatgatcattgcaaccacagtaacagcggttcaacttttaatgaatgcttacacttatacgctttatcaatcactggggatttttattccattaattgtgaccaactgtattattatcggtcgcgcagaagcattcgcctcaaaaaacagcttactccattccatctgggatgggttttcaatgggattaggaatggcacttagtctaaccatactcggcgcattacgtgaaattattggacaaggcacgatttttgagggcatagaaaatctattcggcgaacaagcaaaatttttaacgcaccatatttaccatacagacagtagctttttacttttcattctgccaccaggcgcatttataggcttaggcttgctcctcgccataaaaaatcgaattgataatataaaaaaataaagcaaccaaatcttgccttcccctgcttgcgggggaaggtatcacaaagtgacaaaaagaggctcaaagaaaatcttgccttcccctgcttgcgggggaaagtgtcacgaagcgacggaagggggcttacagtcttctaaacagataattccaataaattaaataggctaatttctacaaaaatatgaacaaaacaaaaagaatcgaaatactcacaagattacgagagcaaaacccccacccgaccacagaattacagtataattcgccctttgaattattaattgcggtcattctatcggcgcaagcaaccgataaaggcgtgaataaagcaacagaaaaactattccccgtggcaaacacgcctcaagcgattttagatttaggattagatggtttaaaaagctatattaaaactatcgggctttttaatagcaaagcagaaaatattatcaaaacttgccgagatttaattgaaaagcacaacggtgaagtgcccgaaaatcgcgaagccttagaagcattagcgggtgtgggtagaaaaacagccaatgttgtgctaaatacggcatttggtcatccaactattgcggtagatacccatattttccgtgtatgcaatcgcactaattttgcagcgggtaaagatgtggtaaaagtggaagaaaagctgcttaaagtcgtacctaatgaatttaaagtggatgttcatcattggctaattttacacggacgctatacttgtatcgcgcgtaaacctcgttgtggatcttgcattattgaagatctttgtgaatataaagaaaaagttgaattttaattttgcggtaaaacaacctaattatttaccgcacttttattaaaaataggataaaaaatgacaacaaacaataaacagcgacaaacttggtcgagccgcctcacttatgtaatgacggtcgcaggcgcaacagtcggtttcggtgcaacttggcgtttcccttatcttgtgggtgaaaatggtggcggtgcttacgttttacttttctgtatcgcaatgattgtaatcggtatcccaatgattttagttgaaaacgtgataggtcgccgcttacgtgtaaattccattgatgcattcggcgataaaattctcgacaaaggaaaaggcatttctaaatattggaaaatattaggttatatgggcttactcggcgcatttggcattatggcgtattatatggtgcttggtggctgggttatttcttatatcattagcctaatcagcggtaccttagacatttcaacccccatcacaaaagacattgccaaaaatttctacgatcttcacatcggcaatagcccttatgaaattatattctacactctcttatttgttatcgtgaattacattatcttggcaaaaggtatcattggtggaattgaacgttcggtaaaatatttaatgccattactatttatcttcttaattggaatggtaattcgcaacgtaacattaccgggtgcaatggaaggcattacattctatttaaaaccagatttcagcaaaattaccccacaattatttatctttgttttagggcaagtcttcttcgcattaagccttggttttggcgtattaattaccctttccagttacttaaataaagaagaaaacttaatccacaccgccgtaattacaggtttcaccaacacaattattgccgtacttgctggctttatgattttcccctcacttttcacttttgggattgaaccaaacgcagggccaacattagtattccaaagtttacctatcgtattttctcacttatgggcaggcaaattctttgcgattatcttcttcggcttattattaattgctgcgctgactacttccatcacaatttatgaagtgatcattacagcattacaagaaaagctcagaatgtgccgtggcaaagccattgtcttaacccttagtggcatttttctattaggcaatatccctgcaattttaggcgataatctatggaaaaacgtaaccattttcggcaaaagcatttttgatttctacgattacgccagtggaaatattctctttatgctgaccgcacttggctgtgctattttcgttggtttcgtgttaaaagatgaagccaaaaaagaactttcttcaacaaaatattcaactttcatcaaaatttggtttaactacgtgaaatttgttgtacccttgatcatcttagttatctttatcagcaacctgttctaaaaattaaaaatgcggtaaggcgactacattaccgacaccgctttaatttgaacataaacatcttgcccaatagcaaaacgcagttcattttgcgcccatttactaatgcttgcccaaatcttatgcccttccactaatacggcaagatccactcgagaatcttgtatctcaatttgtgtaattttgccacgtaaaatattacgaatgcttgtttgttctggcttttgcagagtgatagaaacatctgaactataaatacaaactcgcactcgctcgcctacattcgcgggtacttgatgaatccaaagcacttgttcgcctagcgaaagtgcggtcattttataaggtggattatgcaaatgaacgggcaaggcaagtacactgctctgttcgctttctcctttccaaggggcaaaaatagggctattccaaattttttctactctgtcataggctttcacaatgccgttttccatcagcacaacgcgatcagctaaacgcaacagttcgtccaagctatgtgtaacatataaaatcgggatattaatttctttagaaagacgttccaaatattgcattagctcgcgtttgcggggaacatcaagggcagaaagtggttcgtccatcagtaaaatatcaggatcagtcagcagcgcacgccctattgccacacgttgtttctctccgccagaaagcgtgagcggataacgctttaataaatgagtaatgccgagaagatcgacaatatagttaaaatcatcttgcgatacgtttttcatgccatagcgcaaattacctttcactgtgtagtgaggaaataagcgtgcatcttggaatacatagccaattttacgcaagtgggtcggcaatgattcttggctttccatatccactaaagtgcggtcatttaaacagatgaatccttcgtctggttgtatcaagccactgacaagattaatcaacgatgttttgcctgagccagacaaaccgaaaatagcggttacaccttgatctggcacttgtatattcgcttgcaaggcaagttgcccgagctgttttttcacattaatctgcaacatttccttgtcctaattttttctgcatccgcttgctcaaccactctgacaatagcaaagaaatcaatgaaagaatgatagcaaataaacataagcgagcagtttgttcttctgcacctggtgtttgaataaaagaatacatcgcaaggggaatcgtttgagtttcgcctgcaatgttcgatacaaacgtaatggtcgcgccaaattctcctaatgatcgagcaaaaccaagcacgagtccagctaaaacccccggtaaagaaagcggcaaggttattgtaaaaaatacacgccaagcggaagcacccaatgtttgcgccgcttgctccaatttaatatcaatattttctaaagaaagtcgaatcgcgcgaacaaccaatggaaaggcaaccacggcagaggaaagcaccgcccccttccaactaaagccaaaagataagccaaaccactgatataaatacttgccaatgaaaccattgcgccccattgccacaagcaatagataaccgataaccacaggtggcaacactaaaggcaaatgaattacgccagtaatcagggatttaccatagaagtttttgcgcgctaagagccacgccacaaaaatggctaacggcaaactccaaagcatggaactgactgcaacactcaggcttaaattaattgctgagatttccattggcgtcagattgaaaaatgaaaaaaattgggtaagcaaaatgaatccttatctaaatagcctctctttaaatcccttgtttatgggaatatcccacattgatgagaggtaagatgctctataataacaaaagggcagaaatatccgcccttcatgactattaagattctatcttattttgcagagaaaccataccctacaagcactttcttcgcagcatctgattctaaatatttcaagaaatcgcgagaatccgcattatcatgaccttttacaatagaaacgggataaacaactggtttatggctatcagctgggaacactgcaaccgttttaacttgttgactaacttttgcatcagtgctgtacacaataccgtaaggtgcttctgcacgttcaactaaagctaatgcaccacgcacatcttttccacgcgctaaacgatcttttaccttatcccataaatttaatttggttaatgcttcttctgcatattgccccgcaggcacgtgcgcaggatcgccaacagataaatagctatcttttaatgcattgatccattcacctttagcaatatccacagaatttaccgcactttttgctggtgcgattaagactaaatcattacccactaaaactttttcggtttcttttacggttaaatctttttcagaaagatatttcatccatttattgcttgcagatacaaaaatatccgctggtgcgccttcttcaacttgttttgctaaagttgaagaagaagcgaaagaaaacactacttcatttttcggattttgttttgcgtaatcttttgcaacttgttgtaaagcatctgtcattgaagcggctgcaaatacagtcactttagcggatgccgcaaaagaaaagcctaatcctgcgattaaaagtgcggttgaaattttagttaattttttcataaatcatctcctacgattaaacgttatttacttgattatatattgaaataaataacaatcatatagcaaaagaaaaattatttagtaaaatatataacgcttaggcttaccacttaggattacttaggaacagcaaaatgaaaaacaccgaaattttactcaccattaaacttcaacaagcactttttatcgatccaaaacgagttcgtttactcaaagaaattcaacaatgcggttcaattaatcaagctgcgaaaaatgccaaagtgagctataaaagtgcgtgggatcatttagaagccatgaataaaatcagccctcgcccattgctggaacgaaatacaggtggaaaaaatggcggaggcacggcacttactacttatgccgagcgtttgctccaactttatgatttattagaacgtacgcaagaacacgcgtttcatattctacaagatgaatccgtaccgttagatagtttactcacggcaaccgcacgtttttctttacaaagtagcgcacgcaatcaattttttgggcgagtggcacaacaacgcattattgactctcgttgcgttgtggatgtgaatgtgcaaggattaccaacgccattgcaagtttctattaccacaaaaagctcggctcgtttgaaactcattacggaaaaagaagtgatgctgatgttcaaggctccttgggtaaaaatcagtgaacaaccattagcaaatcaaccgaatcagttccccgtaaatatcaaatcactcaatgaagaggaagccatccttcaatttgctgaaagcaacattgaattttgtgccacagtccaccagccaaatcaatggcaaatcgagcaacaggtttggattcacattgatcaagagcaaattattttagcgacgctggggtaattcagagatataatacgtaaattcaatacttatattattgttttctgaactaaaataaccttaaatcaaacaaaattttaaataaaatatttaatttcatcgtatttcctatttacgtaaaaaagtttgataaagttttttcaataacgaggttggcaataaacgagaaccaaaacgcaatgcaaaagtaaataatccagataacaaaccctgaattcccaaacggtatttcaatttgaacaaacgccattctgctttagcttgattgacgccacgacgacgacttaccatgccatttcctactcgagcataaactaaaatatctggcaaattcgccatatataaaccttgtgcgacaagtttgatccacaaataataatcttcttgaagatcttcatatccaccacaattaatgaccgcacttttttgatatgccaccgtcatgtgattaaacggacaacgtttttgcgtgaatttgataatttcttgagcagacgttggcacattacgatatgccacaatatcatttacatttttaccaaattcagcaatttgtccgccaaaaatgatgctttcagggtgctgttcaataaacgctacttgcttttcaaaacgatcaggcacgcaaatatcatccgtatccatacggaaaacccagtcataatcacaatgcaataaaccctcgtttaaggctttgcctaatcctcgattttgtggcaatttaactaattttaatggcaattttgtttcaaattctgtcacaacaaattctaaatctggcgttactacgccatcaaaaaccaagacaatttcatctgcttgacgagtttgtgcaacaagactttcaaaacactcccgcaagaattgaggattttccttaatatataaggacataaggactgaaaatttcattttattttcccaaccgttttaaattaatagctaattttggcgaaattaaaataaccaaagtaataataaattgcttaatactttttgttttcttaaaaatatcaaaataatattttgccgctttacgcgataaattcataatatggggataagccaaaatatagctcgcgttaatatcaaaattacgagcttgctctaccgttttcacataatgctcgcgaatataatcaatggctttttgcgtattagtggtatccgtagacacacttgagcgtttggtatggaaagtacaataagttagtggttcattaattttataaggagtaaaacttggctcttgtagcagttttaacaagaaatcatagtcttccaaagaacgaagtgcggtggataatccacctatttttaaaaacatctcttttttaatcgcaatcattggcatgccaccaatcttattggctaacaaaatacgttctgtcgaaatttcttggggttcaatcggttgagtcacataggtaaacccttcattaaccatttcacacttagctggatgataaataaaattaatattcggattttgctcaatcacttgtagtactttttcacatttttccggcataaaacaatcatcatcatcgagaaaaagcaaccaatcgccctttgatgtacgcgcaccaacattacgactttccgctgcaccttgattggtttcgttacgaatcactgtaactggaaaagaataactttgttcaacaactactctctctttggagcaatcatccacaataatcacttcaaaattactcgatgtttgttgagttaaactttctaataaagctggcacttctgcttttcgattataagaaggcacaataatgcttaacataattccttcctttaattagccaaatttttcttaatcgcaaagatttttttcaatggatatttcattaattttttaagtaaattattggataaagatccacgaacactttctaaattactgatcaatacaggattttcaatgactatgagagggcgaaccactttatttcttatattaaaattctgttcaaagagtaaaaaatcatccgctaaccaaaatggtttgttttgagaaatttgctgaataaatcttcttgctgctgattttttaataagatagcccacagttcctgcaaaataacttttataagggaaagcgtaatttacatcgcctgtttttttgcataaaaaagaaaaggttgtcggataattaatttctaaatcaaaatcattgaaatcattaatttttgactgtccaagcaatataatttcagcctcaagtttttctgataaaagtgcggttaaattttgctgaaaatctgagtggaataaagcatcgtcttcacagactaacgcatagctatcttcagcaatatcgttgtcttcaacaattttttgatataccgaaagatggcttaatgtacaaccgatctcgcccttagtgacattacgaaaataatgtgctttaaattgttcaatattaaaaatagcagctaattcatcccaatctttttgcatggtattaatggccgaaaacacttggaaatcctcagtatttttttgagaaaagaataattcccgacgttgaatatctttatctaaagagancaaatatttttttaacataaaattatnccttataaaatccctttccattcttcaataattttctcaatgccataatcntcactcattaaacgagatttgtctgacatttgtagataaagntcaggattattgattaataaatctaaacctttaaccatttcttcaatattattttgttcacaaagaaaaccattttctttatgttccactaattgctttacgccaggagaacaattaaaggcaacaataggtaagccaaatgccatcgcttcaataacgactaaaggcaagccttctgtttgtgaaggtaaacaataaattgaactgctttcataataaaaagaaacatcattagtacgaggaataaaattaactgaatcttcaatatccaatgctttagcaagattttttaaattttcttcttcctcgccagaacccactatttttaaattccaatctggatatttttttgccaaaacttgccaaacttttaataaataatcaaaacctttataagaaaataaatgccctacagatagaatagttttattttccaattttgctaatttgttctttggcaaaagcgtatttggattagcaatactaattatattatttgttttaaatttttcttgccacagcgttttttctgcttctgtcaatgtaactattttatcgcaagttgttacagctaaatatttaccgagcgtgcgaacgagacgattgcccgtaaaattaaaagaataatgctcccataaaatatgttttatatttaaattaaccaacgccaaagcagnaaaaagcataattgcaccatcaaccacaattaaggtatccagctgtaattctttaactaattctcttaattttttagtgatagaaaaataatcttttttcaatgaatagggcaatttattcattgcgtaaatattaattttttcatcaacttggaaaaaaggcttgttaccgccaatgctaataaaagaaacatcatatccctgtttagcaagagcattagcaacattaatagaaacgcgctccgttcccccnggacttccgatattcattataaagaaaccaatttttttcattttaaatttccttataaatcgttaatccaaggtctggaaatgaatcgtaacagaattgccatcttggaatactcgttctaataaaacggatttctacattaggatgacttaataaattaaatgcaacagaactgaagaacgtataaataattattttnttatttgataaatgtttaaatacgtaatcttcaaaaattaattcagattcaacataatttaccccatcaactcgataatcttctgctggatgggggaaataataatcaaaaggaatctgatcttttaatttttttattaatgagatgttttcctcttttgtatttaacaatggttgtccaataaaaaatgagacctcgccatctatctcgcaatctatttgattatcccataaagaaattggttcaatattagaaacaatatttttgtaattaggataaaccgtataatgtttttttatttttttaaataatttattcacactatatttatcgccaataaaagctttaatcagtttatatttaaatgtgccaggctctctcaataaattaggatgtgggaaaatattatctgaaccatcatcaaaggtataaagctctttaaatgaaacatgactaagataagtttgtagccataatgaattaagattggcgagaaaaaccttatcaaaacctttgtgcgtaattttattcttaagctggcgcattaacttgagaaaatcgaaaccttttagatcttttcccgtatcaatattcatcgaatcactacaaacctccgctaatttactcgcatacaaggttctttttttatcccatacaccaccaaacattacgccaaagaattgctcgttaggatgtaattcaattatttttctcgcaattaatacttgcaatggtgtacaacaaagcatgagattcatagggttttactcactttagatgtcataaaataaagaataggaataatggaaagcgaaccaataattccagcataagggatatatttaatttctgtaaaagttaaagctacaaggcttgccacataaatgattgtagataaaacggaacattgggaaataagtttatttttcccataatagaaaagataattaactaaaatcaaataaggaatacttaatgtggtcgaaattaaaaataaaataaaataatatttcgttcccacaaattgactacctaaaatccaaactaacacatcctcaggaataatccacattattaaggcaggaataggtattagcaaaaaggaaaataacgcccatttatgtaactgttgaacaactaattttttttgttttaaggcttcataaaaataggggataatcgctttattaagtgcttgaatagcaattgaaacgactaaagcaagttgtgcgcccatggcataaagccctaaatctgtttcactgaatttgtgatagataaaaatacgatctaactgcccttttaagaaaaaacttgcataatgtaaaataagcggcaatccaaatcctaaaatataaaataatgcggattgataatgtttaaattgatatttcttagatgtcgtactctttctgtaaagaaaataagaaaaaaaccagacgactaaattgctcaataaaattgccaaaattcttttttcaacaagatcattttgataatactcaagcaatgcgaccgtaaatacagctcccgtaacagtaagtgaaaattgaataaaagcataagaccaagcctttttctggcattgtcttacacttagctgaacatttaagaaagattggaaaattgaggaaagtgcagcgtaaaataatatttcagactgagcaatccaacagccaattaaaataatactgccgattatcgtggtataagcatagccggtatttaccactaaatttaatgaacgttttccgtaaaaataaaaataacgggaaattgcgccttcttgggttaaagaaaccacaattaaaaataaacttaaaaaagtttgataataagaaagtgagccatacccttctacgcccaatttacgggataaataaggcaaaagcaaaaaaggaactaactttgacgataattccccaacaaggtaaataacactgtctttaaaaactttcataaatatcaccgcacttttgatgaattcgagcgttcgtttatcaaaaaataagggggcttattttaacaaaatcaacatagacaagctatgactaatcattataatgaaaccgctctatatcaaggatcttatctatgttagaactcggaaaacttcttaccgctcttatcgcaccacctcttaatacctttgtattactgattattgcagcgattatttattgtgttcatttcaaaaaattagccaaatttattgcgattataagtttcacttggctttatatcatgagtgctccttttactggtttattgctaacaaataatgatgattctccagcccttaccctagatgaatataaacaagctcaagccatcgtcatattaggcggtggatcttaccaaaccaaagagctatatgcagaaacggcttctggcgcaccacaactagaacgtttacgttatgcggcatttttacaaaaggaaacgggcttgcctattttaaccacgggctattctttgataggcatttctgaaggcgatttaatggcaaaagaacttaaccaattctttaatgtgccaacacaatggatcgaaaataaagcccgtaatacggaagaaaatgccagtttcactaaaaatattttaattaaagatcatattcaaaaaattattttagtaacaaatcaatggcatatgaaacgagccaaatatctttttgaaaaacaaggatttgatgttcttcctgctgcagcggcaagctatggcagcaaaggaaatctatctgcaaaatcttttattcctgacttaggtgcattgaatagcaatatggttttattaaaagagtggattggttattggaaagcccattatgtagaataatttgcttataaaactcgatgacttgttgtttgaaaagaaaattgtatttgctcataaaaaaatctgcaccttagttagttgtttagtccaacttttggggtgcagatcaattcaaggcttttttattatattcaacattttatctataagaaaaaccgaatcccatagagattcggctttaattatgttgtgtttgaaaattattctttatgtattatgacttacgctaattccgcacgtaattttttggttacatccaccatcacttttaattggtcgatggtttctgtccagccacgcgtttttaaaccgcagtctgggtttacccataagcgttcttttggaattacatttaatgctttacgtaataaatgttctacttccgttgccgttggcacacgagggctgtgaatatcataaacacctgggccaatatcatttggatatttgaaatctgcaaatgccgttaataattccatatctgaacgtgaagtttcgatggtaatcacgtctgcatctaatgccgcaatggcaggtaagatgtcgttaaactcggaataacacatgtgagtgtgaatttgcgtatcatcttgcacgcccattgagcttaaacggaatgcttcgcctgcccattgtaagtatgcgtcccaatctgcacgtttaagcggtaaaccttcacgaatggctggttcgtcaatttgaatgactttaatgcctgctgcttctaaatctaacacttcatcagataatgctacgccgatttgtttacatacggttgaacgtggaatatcgttacgcacgaatgaccattgtaaaatagtcacagggcctgtgagcattcctttcattacacggttagttaaactttgtgcatattgagaccaacgtactgtcattggctcagggcgggtaacatcaccgtaaattactggtggttttacacagcgtgaaccgtagctttgtacccaaccaaatttagtgaatgcgaaaccatctaataattccccaaagtattccaccatgtcgttacgttctgcttcgccgtgaactaacacatctaaatctaattcttcttggcgacgtactacatattcgatctcttttttcattgccgcttcgtaatctgcaagagataactcgccttttttgaaacttgcacgtgcgtgacgaatttcagtagtttgtgggaatgaaccaatgtttgtagttggcagaagcggtaaatttaaccacgcattttgcttaacgatacgttctgcaaatggcgatttacgttgatccgcaccttttggcaagtttgctaaacgttctgccacttcagggcgatgaatttcttttgacgttgcgcgtgcatctgctgccacttggcttgcatctaatgcagcttgtacagacgctctgccattatttaacgcttgttttaatacgtttaattcttctactttttgtagcgtgaaagataaccagctgtaaagtgcggtatttttttcttttaattgtacttccacttctaaatcaaatggggtatgcaataatgaacagcttggtgcaatccataaacgctcacctaattttgcttttaatggctctaatacatctaacactttgtttaagtttgcacgccagatattacgaccttcaatcacaccagctgataacactttgctgtagtcttcaaatgccgcaagttgttctggtgcacgaactaaatctaaatgcaagcctgcaacaggtaaggcttttaataattcagcgtgttctgcaactgaaccaaaataagtggctaataataattttgcgttcactttgcttaattcagtgtaaacagatttataggcttcaacccattctgctggtaaatctaatgctaatgcaggttcatcaatttgaatccactctgccccttcagccactaatgcatttaatatttcaacataaacaggcactaattgatttaataaatcgaaacggttaaatgcttcgcctttttctttacctaaccataagaatgttaatgggccaacaatcacaggtttgaagtttaagcctaacgcttttgcttcacggatttggtttacataatgtgctggattagctttgaaagcggtcgatttttggaactcaggcacaagatagtgatagttcgtatcaaaccatttggtcatttcaattgcgaattgatctttgttaccacgtgcaagttggaaatattgatcaagggttaaattttggctatcaaaaccaaaacgagcaggaattgcccctgttgccacttgtaaatctaaaatatgatcgtagaacgtgaaatcgcccactgcaacgaaatccgcattcgccgctgcttgatgtttccagtttttttcacgcaacgctttcgctaaatctaataaatcttgctctgctaattctttacgccaataacgttcttgtgcgaattttaattcacgttttgcccctacacgaggaaagcctaaaatatgtgatgttgtcataataactccaatttaaagtaatttttttaatcatttagacggctaaacgtctataccaatatagaatgcttgatcttcatttattatgcaaacttattattttcaggatttacattaaataaattcataatcaagcattcttttatctatcaaataacgatgaatcaattcagctaacttatttccttaaaattaatctcgcttacgacttaataaccaccaaatcattacaatgaaaagcaagctcgggatcaatgcaccaaaaatagcaggaataccgtaaactacactcgtttgtcctaaaatttcattaacaacataaaataagaatcctacacaaatcccagtaactatccttgcacctgcagtcacactgcgtagcgagccaaaaataaaagataaggctaataacatcattacgccaacggatacaggctggaaaattttacgccaaaacgtgagttcaaaacgactcacatcttgccctgtttcacgcagaaatgaaatgtaatgatataaacctgagatagataatgatgtcggacgcaaagaaaccgcacctaatttatctggcgtcaaactagtttcccaagtttctgataaatgattcgttgtgatgatttcatctttcataatcgttgaatgattaacttgacgcaatgtccatttagcttcatcttcagaataactcgcctggtttgcatgttttaattttattaaattatgctgttgatcaaaggtataaatataaatatcgtctaattttgtatcatccgtcacacgcctaacaaatacaaaatgatgaccatctttcgcccacacaccatttttaattgaaagtattgaaccaccagaaagagccttagcgcgcgtatctcgtgcaaattgttctgtttgtggaattccccactccccaataatcattgtaaatactactaatggtaatgcagttttcattaccgctatacctattttaaagcgagaaaatccagctgattgcataataacaagttcgcttctgctagcaagattacctagtgcaattaatgccccaagcaatgctgccataggaaagaaagtttcaatatctttcggtatagttaaaccagtaaaaattaccgcttgccaaatatcataagtgcctttacctacactacgaaattgttcgacaaatttaataatcgccgacaatcccactaaagtcattaaagtagcaaaaatcgcgccaagaatactttttccaatataacgatcaagggtatttatcatcttttgccgatcctttcttactgaataaatagcgaaatttatacattatttcactgtcccagctattcaacaccacagcaagtaagaaaaatccgatattaacaagcggcattaagagttcagcctctaattttcccgctgaacctgcagatttaaaagagctttgtaacaagaaataaattaaatagagtaaaagtgcgggtaaaattttggcaaatctaccttgtcgaggatttacgcgacttaatggtacagcaatcaatgccattaatggcactgccaaaattaaggtaatacgccaatgcaattcagctttcgcagaagaagaatctaaatcgataagttgagacaatgttaattctgctacttcatcattggtattttctgcggattgataacctaaataggcgtgatattcatcaaaatgcgtaatgcgaaaatctggcaaagcggaggttccttcaacccgttttgtatttttcaaatttaagacttgatcaccatttggcaacgcaattaattcccctttttcagctgttatcactgaaggttttgtttgtttttgaggtgtcatttgaaataaataaacattgcggatttgattatctttaatcttatcaataaataacacaacgttattgttattggtagaaataaactgacctgaagacagcacgccaacggttggattagcctttgcatcttccaccatattcacttgtttttgaattgcccaaggcgaaagccataatgcgttataagcggcaatacctgccgttaataaagacataatcagtgccactttaaccaaaatccgttgccccacaccgcacgcgcgcatcactgtgatttcactttcagcgtaaaggcgaccaaaagtcagtaaaattgcaataaataaacatagtggcaacatcaactgcgccattgttggcattcccaagcctaataaagagaaaaccaaatcagctggcacattcccatttgccgccgcacctaatacacgcacaaactgctgactaaaaaaaatcaatagcaaaattagtaaaattgcgatttggcttttgaaaacttcttttattaaatatcgaattaaaatcatcttatttcgtttgtttttctaaatctaaaacggaggaaaactggataaaatcggtcgcatatgataacttattttcgctgaattaaacagaaatttaaggacaacaaatgaaatatcaagcaaaaaataccgcactttctcaagccactgattgcattgttttaggcgtctatgaaaataataaattttcaaaaagttttaatgaaatcgatcaattaacccaaggttatttaaacgatttagtcaaatcaggtgagctcactggcaaattagcccaaaccgttttacttcgtgatcttcaaggtttatctgctaaacgcctattaatcgttggctgtggcaaaaaaggagaactcacagagcgtcaatataaacaaatcatccaagctgtattaaagacactaaaagaaaccaacacgcgtgaagtcatttcttatttaactgaaattgaattaaaagatcgcgatctttattggaatatccgctttgccattgaaacgattgaacacaccaattatcaatttgatcatttcaaatctcaaaaagcagaaacctctgttttagaatctttcatcttcaatacggattgtgctcaagcacaacaagctatttctcacgccaatgccattagctcaggcataaaagcagcacgcgacatcgcaaatatgccaccaaatatttgtaatccagcttatcttgctgagcaagcaaaaaatttagcagaaaattctaccgcactttcattgaaagttgtggatgaagaagaaatggcaaaacttggaatgaacgcttatcttgccgtctcaaaaggctctgaaaaccgtgcttatatgtctgttttaacattcaataatgcgccagataaaaacgccaaacccattgtacttgtaggcaagggattaacctttgatgcaggcggtatttcacttaaacccgccgcagatatggatgaaatgaaatatgatatgtgcggtgcagcctctgtcttcggcacaatgaaaaccattgcacagttgaacttgccattaaacgttattggtgttttagcaggttgtgaaaatctgccagatggcaatgcttatcgcccaggcgatattcttaccactatgaatggtttaaccgtagaagttcttaatactgatgcagaaggtcgattagtgctttgtgatacccttacttatgttgagcgttttgaacctgagcttgttattgatgttgcaaccttgactggtgcttgtgtggttgcactagggcaacacaatagcggcttagtttctacagataacaatcttgccaatgcactactccaagccgcaacagaaaccactgacaaagcgtggcgtttaccattaagcgaagaatatcaagagcaacttaaatcgcctttcgccgaccttgccaacattggtggtcgctgggggggcgcaattacagcgggtgcatttttgtctaatttcacgaaaaaatatcgctgggcacatttagacatcgctggtacagcttggttacaaggtgcaaataaaggtgcaacaggtcgccctgtttcgctattaacccaatttttgattaatcaggttaaataaccacaaaactggcacacgttgcacctttaaatcgattactctgctagttcggtttgctcgtgtgccatcagttcctgacccacatcatcaagcaaacttagataacgttcatattgtttcaacatatcggcaatcaattcatcttgatccatatattgaacatcgtaaccgactcgtccatcaaaaaaataagtgtaaggctcgtaagtagcactatgctgaatgtgcggtagattttcatcgttaattaattgctctgacacttctcgcccaacagatttaataccatacataaaatctcgcattgattctttatgaattaccaattccaaagctggctcttcttgttcaaataatgtgttgatttctacacttaaattatattttcctgttaattcttgacgtaattctcgcatagcgggtaacgccgtatttttaaggaaacgtaaaatatctttctcttgcgtttggttcatcatttgctctaaatgtgatttccatttatcgccgctccagaagatactagttggattgactttagtagaaaaatattttttatccgcaattaagcctttccataaactaaaacacattaccaacatcaataaagcaaaaggcaaggcaacaattaatgtcattgtttgcaaattagcaagtccaccagattgcataagcacaatcgcaacaacggacattaaagttccccacattatggcttgccacgcaggcgaagctaaacttttatcacgagatgcaatgttatttaacacataaatacctgaatccgctgaagtgataaaaaacaataaaatcactaataagctcacaaagcctgttattgttggtaaaggcagataatttaaaaatttaaataataaaatttctggggaagaaataaattcgccaagcccgcccgcagcaatgccatcatttagccatactgctgtattaccaaaaacagtaaaccataaaataccaaataaacttggaataactaatacgccaaaaataaattcacggatagttcgccctttagaaatacgcgcaataaataaacccacaaacggagcccaagaacaccaccaagcccaataaagcacagtccatccgctaaaccagctagtatgttcttgttcataagcataggttttaaaactgagttgcactaaattgctgaaataattaccaatattgtcgctaaatgcagataaaaggtataacgtagggcctgaaattaaaacaaagagaagtaaacaaaatgctaaagttaagttaatttcacttaatattttcacgccttttccaacaccagaaatagcagaaaacaccgctaaacacatcaccacaacaataacgccaacttgtaaggcaaagctgttctgacttatccaacctatttgttcaagccctgcaccaagctgtgatgaaccaaaacctaatgtggtaataatcccaaataatgtggcaagtaacgccataacatcaattgcatcgccgattttgccattaatacgatcttttaataaaggataaaaacaagagcgcaacgctaaaggtaatttataacgaaacccaaaataagctaatgctaaagcaatggtgccatatactgcccacgcgtgaattccccagtggaacagagtatgaagtaaagcctcttgttgtttatgttctgcagaacctgctgtaatgtcagaaagataatgggttaatggttctgctacgccaaaaaacatcagcccaacccccattccagcggcaaataacatcgcaagccaagataagaaactaaattcaggttcttcttcatcttgccctagttttatattgccaagactacttactgataaaattaataaaaatcctaaaaacactgaaaaagtaagtacataaaaccaactaaaattagcaaaaataccacttttagcttgattcaataatgcttgagtttgctctggcgcaataaaaatcattgccatcagtaacaatataaaaaataacgtaacgccaattaccaaaggattaaatgacgttcgctttgtcataaattgagataaagacaaacttttccccttaacgattaaatgaatagattaaaaatagatttaataaacattgcctagaggcaaaaatgtgtaatggaaccactacaaaggacagcacatagaagtgcgattttgaaggaaacgttcagtaggaattgaaggattgtttccaaaaacttgtgcatattaacaaaatacagtcattatttcaaattagtgaaagctaaactaaaaaatgcggtaaaatttacaaaataatttaccgcacaaatatcatttattttaaagccatttctacaaggatattattgcttttaagccaattcttctcccctcttttacaacattttctaaccgcactttaaatccgtgtaattccgcaattcgcataacaatagaaagtcccaagccacttcccttttcattttgcccagctggacgataaaaacgctgtccaagttttttcaaatcttcaggttcaacgccaccaccattgtcctcaataataatctgtgaggatgaaatttttactgaaacgattgtatcttcaggacaatatttaatagcattgtcgagtaaatttctaagcatcaatgaaactaaaattgattgcccttgtttttgctttggttcagattctttctcaaaaaccaaggtaattttacgtttttctgccacaaaataacgctcagaaattaatgattgaacaatagcttcccaatcaagcagctgtagtgtttctaaggcttgcaaattatccaagcgggaaagcgttaataattgttcaatcaattgcgaagcccgatcaatgccttgcgttaaatgtaaaagtgcttgttctcgtaacgctacatcatcgccagctagttgcgcaacttcaatttgaatacgcaatgccgccaatggactacgcaattcgtgagctgcatcagaagtaaaacggcgttcgcgttgcaacatagctgaagtgcggtcaaaaaattgatttaaattttttactaagggtaaaatctcaacgggtagcccctccgtattcagcaatgacacatcgccagattttctcgtttgtacttcttggcttaaacgtttaatcggtcgaagttctttatgaatcaaccatcctaaaacaatgatcaaaataggcaaactggcaaaccaaatccacatttgccccaaaatcatttcttcaattaaatcttcacggtaatctaattcttgccctactgcgataactaattctccattagctgccatacgccaaaaaattcgccatttatcgtcatcatcataaatattcgcattataaaaccccgttttataattaaaaataaaatcttttccatttcgtccatcactgaataaaagtttcccagttttagaaaaaatagcaaaggctaaggcatcatcgtcataacttttttttaataccgactgtgaatttttatttagcgttgtgctagattccaacaaaatagtacttaaatctgaatttgcgagccgttcagcaaagagaacttgttgtgcatcaaaaactttattcacatcgtggcgaacttgccaccaagccacaagcgtagaacccagccaaacaaaaagtgcggttaaacaaagcacagaaataagacgcaacgtaaggcttctatttttcatttttcaacttgtcccaaagcatatccaacaccgtgtactgttcgaataaattgcttccccaatttttggcgtaaattataaatatgcacatccaatgcgccactactaatttcttcatcccaactggataatttttcttcaatggatgagcgagacaatacgcgatctttattcagcataaataattcaagcaatttatattcacggcttgttaaagaaatgggttgattattcagccaaacagaacgttgattctgatcgagcttaacaccagcctgttctatcacagaatgatgatatccataacgacgacgaataagggcttgtaaacgtgcggcgacttcagccaaagcaaaaggcttgcaaagataatcatctgcaccactttgtaaacctttaactcgttcatctaaagtatcgcgagcagtcaaaattaatacgggaacatcttgatgattagatcgccattgttgcaatacctctaatccatcaagtttaggcaaggttaaatccaataccaccgcatcataaggcgcagaggttaaagcagccattcctgtttttccatcagtaaaccaatccaccgcaaaaccaagtttggttaaaccaatctgcaacccattgccgattagattatcgtcttctatcaataaaattctcataaaaaattgaccgcactttataaacaaaaacagcgagctaatgctcgcattttcagaaatgattattctgctttttcgatacgtaatacatcaagctccgctttctcaaatacctcattatccaattttccataaattttcactttatccttagaatctacgtttaaaccattccaaacgcgttttttaatttcaatcttgatttgcccagtcccatcagtaaaccaaaactcatcgtcatcaatttgctgagtgatattccccactaaagtaatcattgaattatcagccgcagataaagcttgttttacactaattgcagcaggggctgcttgttgaaaaccaccttgactattattgccattaaaaccagcaaatgctgaagtggttgctaatgcgaagattgttgctaatgcaaattttttcataacgtttcctttttaagttagttaatttcaagctccattgcttggatgtgtgtattaaaacaaataaatcttaataaaagattaagaggactatacttttttgaaaagactttatcaaggcaattttgcgaccactgcatagccttcaattaatccttccacttcataagccgcacctgcagtaatgaaagctacctcaccttgtttcaaagaaagtgcggtcgtttctgaacgtaaatttaactgccctttcattactaataaaatactcgcactttgtgcttttaaatgatgtgtttcgccacattcatattgaatattttgcaaagcgaaatcttttgctgacgtggcgtaagtatacctacggttaattatagtcgttcctctttgaggaacttcaaactaccccaacggggtagcacttaaattagcctagggtatacttaccctaggtaactataataaataaaaaatccgcacaaaggcggactttttttaccgtaaacaaattatttctttaaggctaataccactgattctccagccactacttcgcctgatttttttacgatacaagaaatttcgtccatatttgaaattacgattggtgttaagacagattttgcttttgattctaatagcgcaagatcaaattcaatcacagtatcgccacgcttaacagattgcccttcttgtgcaatacgagtaaagccttccccctttaactcaacagtatcaataccaaagtgtacaaataattctacgccttcttttgattccattgaaaaagcgtgattggtttcaaaaattttaccaatcacaccatccactggcgcaacgattttgttaccaataggacgaacagcaacaccatcaccaacaattttttcagagaaaaccacatcgggaacatcttcaatattaacgatctcgccagagatgcgtgcataaatttcaacttccacagatttgttttcttttgaaccaaataacttgtcaaataagcccattttaatctcctatccattcaagatggttgctattttaacgtaaaatcaaataattttgtttaatttaatgaattttccagcaaaaattcttcaattaattgatcaatttctgcagcggtcggtttttgtaatgcagtatcagcaagcacttttgcatcttgaaaatttacattacggattaattttttaattcgaggtacagaaatcgcactcatactaaattcatctaatcccataccaagcaataataaagtcgcacgttcatcccctgctaattccccacacattcccgtccattttccttctgcgtgagaggcatcaatcacttgtttaattaaaccaagcacagaggggtgcatcggattataaagatgggaaataaactcattaccgcgatctacagccaaagtatattgagttaaatcgttagtaccgatactaaagaaatctacttcttttgctaaaaattttgcatttaccgcggcagagggggtttcgaccattacaccaacttggatattattatcaaacagtctcccctcttcacgtaattccgcttttaatgtttcaataaccgcttttaattcccgaatttcttctacagaaataatcatcgggaacatcaccgccaatttaccaaaagctgaagcacgtaacaccgcacgtaattgtgcatttaaaatttcacgacgatctaatgcaatgcgaatcgcacgccatcccaagaatggattcatttcttttggtaaatctaaatatgaaagctctttatcgccaccaatatccatagtacgaatcactgttaaacgtccgttcattgcttctaccacttgtttataggcaataaattgttcttcttctgtgggaagctgttcacgatccataaataagaattcagttcggtataacccaatcccttccgctccattacgttctgcgccgtcacaatcacgaatcgtcccgatattcgcaaccacatcaaccttatgtccatctaatgtgattgcaggaagatcttttaatttagctaactctgctttttcctcagaaattttcgcttcaagtgcttttaattcatcaatctgagatgctgttggattaatataaacttggttattgatagcatctaaaattaaataatcgcccgtattgactaatttagtcactttatttgtgccgacaatcgctggcaattctaaagaacgagccataatagaagtatgtgaggttctaccaccaatatcagtgacaacccctaatactttttcaagattaagttgagctgtttctgagggagtcagatcataagcaacaagaatagattcttcctgaatatcaccaagatcaacaatgtacattcccaaaatatttttaactaaacggttagcaatatcccgaatatcgcctgcacgttctttcaaatattcatcatcaatttcagataacattgtcacttgttgatctaaaattttactcgccgcaacgcctgcattcactttatttgaacgaagataatcaagaatttcttcttctaattcttcatcctcaagaatcatcaagtgaccttcaaagattgccgctttttcttcgcctaaagaaattaatgcacgttctctaattgaattaagttgttctaccgccgcgttacgcccttcataaaatcgagcgacttctgcgtcaatttgatcatcagtaattttttgtgtatcaagaacaatcttttcttctttaagaacaagtgccttaccaaaggcaatacctggagatgcgagaatgccagaaatcatagataccttccgaaacaattaacaaagtaataaataaacaatagccataaaatttcacaattttatggctaagtaagaattattctaaagttggaattaacgcgactaaatgttcaactgcctgttgctcgtcttctccatcagcagaaatggtaagtattgttccctgcgttaaagctaatgtttgcaacttaaataagctctttgcacttgcacttttccccccagaggttactgtaatttcagaagaaaatgctttcgcttctttcacaaattgtgcagcagggcgcgtgtgtaaaccgtttgacgcaataatttccacatcttttgaatacataatgctacctcgactaatcaataattaaaaatataaaaccagaaaattgccctagtatcctttttcaaagcaaaataatcaagaataaacactaaaaagcctgaattaaatcataaaaataagctaaatagtttatttattattcacaatctcaatcgttaaactaatgaaaaatgacgttgtgattttgtttcacttaaactttcaattaatcgatgatagttatcataacgaacaggcgaaattttgccttgctcaacggcttcacgcaacgcacatcctggatcgctcaaatgtttacaatcacggaatttacaggtgcccaaaacatattgaaattctcgatagccttttgtgatttgctctgcatctaaatgccaaagcccaaattctctaattccgggcgaatcaattaaattaccgccttgtggcaaatggtaaagacgtgacgatgtcgtggtatgctgacctaaccctgacgtttcgctcacatcccctacttgagcgtttacgctaggcaaaatatgattaattaaactcgatttaccaacaccagattgcccaacaaaaatcgccgtgccttgtgccaaaagtgcggtcaatttttccatattttcaccgctctttgctgaaatcattaaaatttcatagccaatatcttggtaaattttaagttggtcttcaatttcttgacgctgttcctgcgccagtaaatccactttattcaaaacaatgagaggcgtgattcccgcaatttcacacacaacaagataacgatcgataatatttaaggaaagcgttggcaatactgctgatacaataataatacgatcaatattcgccgcaataggtttcaaaccatcataataatcagggcgggaaatttcattttctcggggatggatcgcctcaattacgccgctcacaccttgtaattgttcattgcctttacgccaaacaactttatctcccaccaccaaactcgacaaggtacgacgcaaattacaacgataaatttcgccttgttcattttcgacatctgcatgaatcgaataacgcgtgacaacaacgccttcttgcgattcacccagcatttcatctgaccattcaatctcttttttcttatggcgatgtaatgttttcgcattatttgattgaattcttcgagtttggttttgagttaatttacgtttagccataaaagtgcggtcgttttttcccttgtttttggtaaaatgaaaaaaatttttgcataggatacctgatattatgtcattcgataaacaaaatcttatttggattgatttagaaatgaccggtttagatccggaaaaagaacgtattattgaaattgcgactattgtgacagataaaaatttgaatattttggcagagggcccagtattagcggttcatcagtctgatgaattactcaataaaatgaatgattggtgccaaaaaacgcatagtgaaaacggcttaattgaacgcataaaagccagtaaacttaccgaacgagcagcagaattacaaaccttagactttttaaaaaagtgggttcccaaaggtgcgtcgccaatttgtggtaacagcattgcccaagataaacgcttcttagtgaaatatatgccagatttagccgattattttcattatcgccatttagacgtgagcacattaaaagaacttgctgcacgttggaaacctgaaattttagaaggttttaaaaaagagaatacgcatttagcgctagatgacattcgagaatccattaaagagctggcttattatcgcgaacacttcatgaaattagattgacgaaaacttcaacaaaaaatttctttttatgaaattgcccttgcaagccctaaaaatatttgtataatgtgggctcattcactgatgtgaactgcgggaatagctcagttggtagagcacgaccttgccaaggtcggggtcgcgagttcgagtctcgtttcccgctccaaatttcaatccctagccaaaaggctggggatttttctatctacaaaaatagatcaccaaaatcttaaaaagtgcggtgaattttctcaaaaaataaaggcttgtgatttaataacacaagcctttatttttttatgctttcttcaaccgtttggcacgacgtttcattcttcttacccaacgggtaattcgccatgcatgcgtaattgaatagacataaaggaaaaataaaatgaaaaagccaacaaacatcgcccactcattcacataataaacttcccctaaaataccgatagttgcacaaactgcagaaacaaacgtaatcaataaaaaggcttgtcttgatgttaaacccgctcttaccattaaatgatgaacatgtaaacgatctggacggaatgggcttttacctttacgtacacggcgataaataatcgcaaccatatcaatcaaaggaatcgcaataatccaaagtgcggttactggattcataggatgcccttttccttgcgtacttaataacaaaatccaaataatggtaaagccaattaatgtactcccggcatcccccataaacaccttatattttggtccaaatggaatccctagattgagcatcaaataaggtaaaatcgatacgattaaagcaaaactccaatgcgccatatccatttgcccatctcgatacattaaaataccaatcgccgcaaaagaaacacaagagagtcccccaagcaatccatcaataccatcaatcatattaaaggcattaataatcgcaatagtggcaaagacggtaataatcaaaccaattgaaccaagcgttaattggaaaggccctaaaatttgaccaagatgatcaagataaatattcccaagatcgatcattaaaatcgccaatattgcttgaatgcctgctcttaaaaaagggctaatatcaaagcgatcatctaaaatcccaatcgccaataaaacaaaaatactgaacaaataaagatacggtaatcgaagttgatcccattccatcagataatagcaaagattaccaacaaaaagcgatgcgccaccgattagtggaattgtgccttgatgacgtttacgatagtttggtttatcgactaatccaatccaattggcaagtggtcgcatcacaatcaatgttaaaaacgcgccaagaaaagtaacaaaaatactcagcatagtgtgaccctaaaattttttgtaaaggataacataaggcaaatttacctagaaatatatttttaacgaagccctatttttcacttcaacgcccgtatttttataaaaaatgcggtcaaaattgaccgcacttttacgcctatcttttattttaccagtggtatcctacactccccccccattcacatcacttcggctaaatagatttctgatctttgcggatttgcactttcaagctatcgtgttcagtacgaagctgttgtaactctactttactcgctccttcccctaacatctcaacaaattcagtttctgatttaccttgattagctgacaatgctttccaactttcatgagcagattttcctcgttctccttgtccgccttgttcgccttgttcgccttgttcgccttgttcgccttttaattcaggccatttgcttaatggtttctttatctaatgaaacaacggtttttccatttttttcttttgttttcaagccatcttcaaaagtataaagttgtttcaaaagcattttaaagttatcttctgtaaaaatggttttatcgccagcttttaaaacaccattatcagcagtaagtgaaactgttttcgctttagcaccatttcctaatactaaagcccctgcagaagttgtcgctgaagcgtgatcgccaccaacaaaagcactatcggaatctgtcacgctagttctattccctaaagctaccgtactgtttgatcttattgattctgtcttacttcccaatacaatcacatctttggaattttctgcttttgctgcgaaatcagtaacaatagaaatatttgaattcgttgcattagcttcaacaccttgaacaattgctttttctgatttttctacttttgcattagttcctgcggctaaactatactcagaattaagaaccttagcattctttcctaaggctattgagtacggagattctgttacattagcatttgcccccacagctattgatgcggcaggattatcaggtgtcttatcctttgggtgtgtatatttcgtatctgaatctttaactaacgcattatgcccaatagcaatacttaaccgagaattctcaattttagcgtcattattttgagctgttccactagctgttaaatcagtatcattggtaatttttacatattttgttaaatcactttcttccctatttatttccattcattaaaaagaaacctttgttttgttgttttatatttttaataaaatagagatatttacctaatttgctgaataataacactgttcaatctttccctctcctctcttgcaagagcttgcccaaattgattcgtcaaaataaaaaagtcctcggctttttcgcctacggtggtaattttcgcatttaataaatttagatttaactcagtaaaaatctggctcacttgggctaataaccctgctttatccaaggcaaccagttccatttcagtatgttcttttttgttttcctgtaaaaaacgcacgtcggtttgtacagtaaaatgttgaagctggcgattaggcacaatagaaagtgcgggtaatttttcactttgaagagctactgttagggcttgctctagttctcggcgacgatcaaattcaaccaattctccgttaagttctgtgatgataaagctatcaaaaacataaccatcttgtgtcgtaataatctgcgcatcgtggatactgaattttttggcgccaatggtactcaccactttattaaataagtgcggttgatcttggcaataaataaacacttccgtgccgccaagtgaaaagcgattactaattttcactaataatgcctcaacgaaatccaccagcaaacttgtatgccaggcgatttgctttggcgtattacgcacaaaataatcttctggacaacgagtccataatttctcaatagagattgacgtaatatcagaataatcctgcgttaaaatttgttgtgcaagttttcggttttctgccgatttttctgagtaatcaagcaattctttcatgccttgtgaaaattgctgttcagtaaattcatataaagaggcaaaaagcgaacgtttccagctattccataaattaccattggttgcacaaatatccgccaccgttaaacaggtcagataatctaatcgaacttgattttgcatggcttccgcaaaattcattacgacttcaggatcatgaatatcacggcgttgcgccgtaattgacatcagcaaatgggattgaactagccaagcaagggtatcaatttctcgacgatctaaaccatgtaattgcgcaaagtctgccacatcttctgcgccaagttctgcgtgatcaccgcctcgcccttttgcaatatcgtggaacaacgccgcaatataaagtaaagtgcggtcagaaagttggctaaaaattcgatgagcaatgggatgttcttgagcacttccctttggcagaaaactttccaatttcaacatcacgcgcaatgtatgttcatccaccgtataaatgtggaacaaatcaaattgcattaatccctcaatggcttgccattgcggaagataagctgttaatacaccatattggtgcatcggcataaacgcacgcttaatcgcattagattgattaaacaaacgtagaaatttttctcgagctgcaggaatttcgcataatttttgtgataattgctctaaggaaatttgtaattgacgcaaagtatcagaatgaatattgacatgttcgtactgcgttaaataaaagaatagatctaaaattcgcgctggtttttcttgaaaaacaaagctattacgcaaacataaggattggttaatcagttgaaaatcatcgtctaattggtcaatcacagtatcctgatttgatgaaagcacattttctcgataatgctgaatcaacaaattactaataagcgaaattcggtgcaatgcttggaaaaaacatttcatcattttttccacagctggattgccttcccctcgaaagcccaacaattcactaactttaatttggcgatcaaacaacagacgattatcgtaacgtttcaaaatcaaatgcaaagcgaaccgcactttaaataaaaatgcacgactttcttgtagttgctgatattcttgaggataaataaaaccactttgtaaaatagcctcaagggtcaaagccccagaatggcgcaacgccacccaatacaacaaatgcaaatcacgcaaaccaccagggctgaacttaatatctggctcaaggttataagccgtattgtgataacgctgataacgttctatttgctcttgcactttggcattaaaaaaatcctctttcgaccaaaaatctgcacgttttaccaattcatttagtacatcaaagtgcggtcgatttccagtgagaaatcttgcttctaataaattggtggcaatcgtaatatcttgttttccttccaattcgcattgttctaaggttcgaacactatttcccacctcaaagccacaatcccataaaaattggataaattgagtaattttttcttcaatctcatggcttggggtttgctcaactaaaatcaaaaaatctaaatccgacaaaggaaacatctcacgccgtccataaccgcccaccgcaattaaagaaatgccttgctgttcacttaatcctatttcctgccaaagttgaatcaataaggcatcataaaaatcacagcgattttcaataagctcaaaaatggaataacaagaaaaattctctagctcaaattgcttgagattttctcgttcaattttgaccgcacttggcgttaaaagagaagatagtgtcggagaaaacagcatatgaattgccttttgttagatcgaagtcgttttattataaagaaaaacaaaaagggcgtatatgatctgcaccccaaaagttggactaaataaccaactaactaaggtgcagttttttatgaccaaatacaattttcttttcaagcaacaagtcatcgaattttatcttcaaaatgataaaaatagttcacttacccgcaggcattttcaacttgccgaaacaacattagaacgttggattaaccaatttaatcatagtggaatcaatgggctagccttgctgggtaagaagcgaaattactcacctgaatttaaacttaacgtgatacaagcggttaaaaatgggaaattttctgcagaagccgcttgcttacattttggcattgccaattcaggtgttgttagccaatggttgcaagcctttgaaaaacaaggtataaacggcttaatccccaaacctaaaggtcgcccaaccatgaaactccaatatcctaaaatgccgcctaaaccgaaaacacgagaggaagaactagaattggaaaatctccgactacgtgcggagaatgccattctaaaaaagttgcaagagctcaaccaacaaaaaatgcagaaaaagccgctatcgtaaaggcattacgcgttcattttccgctgcccattttattagatttaatcggcttggcacgcagtgttttcttctatcacttgaagacgaaaaacgataaaaatgcagcactctcacaagaaatcgcctctatttatcacgataatcacggaaactatggttatcgccgtgtgacgtttaagctaagagaaaccattaaaattaaccataaaaaagtgcaacgtattatgcaatggttggggcttaagggaaaatgcaagacacaaaaatatcgttcttatcaaggtgaagtcgggcatattgcggataatctgttacaacgcgattttacggcaacacagcctaatgaaaaatggacaaccgatattaccgagttcaagtgtgcggaaggcaagctctatttatccccaattaaggatttatttaacaatgaaattattgcttatgatttagcgcgaagcccgaactttgagcaaattaccagaatgatgaaacaagctgtagcaaggcttgaaggcgcaaaaccgattttacattccgaccaaggttggcagtatcagatgataggttatcaaaacatactcagggagaatggcattcaacaaagtatgtcaaggaaggggaattgtttatataacagtgcgatggaaagcttctttgggagattaaaaacggaatgttattacggcaaacgatttgaaacgttcgaacaactggaaaaaacgattcatgaatatattcattattacaaccatgaacgcattcaggggaaactaaaaggactcagccctgtgaattacagaactcagtccttgaactaaatcagtctaactttttggggtcagatcaatatctacgcccttatcttataattttatgccaattacacattcaccataatccgcgaaattcgaccttctgcaatttcttcatcgcgaatagtcattacttcacaaccagtttccgtgacaataagttgatgttcatattgtgctgaatggctgcgatctttggtttttactgtccaaccatctcccattacgcgcacttcttttttgcctgcgttaatcattggctcaatggtaaacaccattccgggttttaaaatcacgccgccatcatcggcataataatgcaatacttgaggttcgcagtgaaattccgtaccaacgccgtgtccgcaatattcacgcacaacgctgaaagtctggctttccgtatatttttgcacggctttacctatttcatttaaacgaatatcgggttttacagtgcgtatcccaacatataatgcttcttgtgccgcttccactaattttttactacgaatatttgtttctccgcccacgatatacatttttgagttatcgccaaaataaccgtctttaatcacggtaacatcaatattcacaatatcgccattttttaacactttatcgtcacttggaataccgtggcagacaacttcgttaatggaaatacaggtcgcctttgggaaaccgtgataattcaaacaagcagggataaccttttgttcatttaccatatattcatggcaaatgcgatcaagttcgcctgtggttacgcctgcttttacgtaaggttcaatcattaccagcacatcggaagccaatttgcatgcctcacgtaactttacaatttctttttcagttctaattggaatagccatttttatctcacttttttgaaaaaactttacgagattatagcacgatttctaggaaaaaactggattgcacttgaatggagtaaagggttattagataatggcgggattgaaattttaggaaagtaggaaatagttatgatagatgatatggcggtgccactgacatttactgatgcagcggcaaataaagtaaaaagtttaatcagcgaagaagaaaatactgatttgaaattacgcgtgtatatcacagggggtggttgcagcggtttccaatatggttttacctttgatgaaaaagtcaatgacggcgatttaaccattgaaaaatcaggggttcaacttgtgattgacccgatgagcttacaatatttaatcggcggtacagtcgattacacagaaggtttagagggttcacgttttactgtaaataatccaaatgctaccagcacttgtggctgtggttcatcctttagtatctaagatggattttcaatttacacattatcaaggcaatgtatccgtcaaatgttcgatggaacacattgcccttgctaactggttcaacacagaagtgcggtcaaattcagacaagattttaaccgcactttctactgcaaaatcacttattgaaaatcaagaaaaagtcttaattggcacggaatatacgttatttttaaatgctgatgaagtaatggtgcgagccaacaatctcgccattgaatcagatgaaattttagaacaagatttccattattatgacgaagaaagccttgctttttgcggtacgcaagattttattcattttctccaatcttatgttgattttattgcttaactcactatgacttctcaacactccgctaaaaaatcatcgaaaaacacgccaaaaaataaccgcacttttaaaggttttttacttaaatttagcttcactgcacttgtcttaacgattttttacggcggttatctcgattggcaaattcgttctaaaatggacggtcaaatttggcatttgcctgcggaagtttatagtcgattagaaagtgtgaaaattgccgataatctcgcttttgatgaagtcattcaaattttattagataacgaatatcgccaaacgaccatggttgccgcccctggcgatttcaaattagaagatgatagcattgtagtgcttcgccgcgcttttcctttccccgataaagcagagcctcagcgagttttgcgcttgcgttttagccataataagttatctcgcattgaagatttagtgacggtcaaaactgttgatgaatttcgtcttgcaccaaagttgattgcgatgttgcaatcagacaacgaagatcgccttgctattcctttacaaaattatccccgtttattaattgatacattaattttaacggaagatcgccgcttttatgaacataatggcattaatccagtggggattttacgtgcattaattgcgaatattcgtgctggtcaaacggtacagggcggaagtacgctcactcaacaattagtcaaaaatttatttttatcgcgcgaacgcaccattacacgcaaagccaacgaagccttgatgtcattggttttagattggcgttacgataaaaaccgaattctcgaaacctatctcaatgaaatttatctcgggcaaaatggcgatacgcaaattcacggttttgaattagccagccaattttattttggtcgttcgattcgtgaaattagcttagatcaaattgcccttttagtggggatggtcaaaggcccttcactttataatccgtggcgtaatccacaaaacgcactcgaacgtcgcaacattgttttaaggctaatgcttgaacataaaatgatcggcgatgaactttatcaattattaagtcagcgacctttaggtgtgcaaaagaaagggcaaatctcgcgtaaataccctgcatttattcaaactttacaagcagatttacgccgtaagctgggcgaacacaaaatatcgagcttacttggcgcacgtattttttccacaatggatttaaaacaacaagctcaagcagaaaatgcagtgggcaataccgtttcgcaattacaactgaaaatgaaaaatccccatttagagggagcgatgattataacggattatcgcacaggcgaaattcgtgcagtagttggcggtttacaaacgcaatatgcaggctttaatcgtgcattaatggcaaaacgtcagattggttctttagtaaaaccttctatttatttgaccgcactttctaacccagaacagttccgtttgaataccccaattaataaccaaccaataacaattaatgtcaaaggtagcccgccgtggcagccacgcaactatgacaaaaaatatagtgattctgtaatgttaatggatgccttagcccgttctttaaatattcccactgtaaatattggtatgaaagttggcttgagcaaagtcattgacacgcaaaaagcgatgggctgggacaacgtggaaattcctaaagtgcctgcgatgttgctcggttcttataccatctcgccttatgatgtcacaaaactttatcaaacccttgccaatcaaggtgggagaattgcgcttacaaccgtcgatagtattgcagatcgtcaaggtaacctaatttttcaacacgataaaagtgcaaaacaagtggtgccacaagaagcggcattccaaaccttatttgcaatgcaacaaactgttgaacgtggtacagctcgcagtttgcaaaaggattacgctgatttacatttagcaggcaaaacaggcacaaccaatgaatcacgcgatacgtggtttgtgggaattgacggaaaaaatatcagcaccgtctggcttggtcgcgatgataatggcgaaacaaaactgactggtgcttctggcgcattgcaaatttataaagattatttaaaccgtacaaatattgaaaaattagcaattactccccctacaacagtgaaatgggtggggataaatcaatacggtgactgggattgtgagagttatcgaacaattcctatttggctaaataatggtcagaatttctgtggcgaaacatcatctccctctctcacgccaacaactgaaacagaaacaccaccacaagaaagcctgtgggacgtattggataatcccaatccacccgctcaataattaagccgtaggatttactaaatttccaataataaacattttccccctatacttcccctaacatttcagaggatttttatttctttttaaaaaatagcaaacgtttgctttatttgatttaaaagtgcggtacaatacgcgccagtttttactttcatacaggtgcaaaacgatgacacaacaactccccattttaagtctaaaaaaaatctattcaggcaaagtacgcgatctctatgaaatcgatgataaacgcatgctaatggttacttctgaccgcttatctgcctttgatgttattttagatgatcccattccacgaaaaggcgaaatcctaactcaaatttccaatttttggtttaataaacttgctcacattatgcccaatcatttcactggcgacagcgtttatgatgtgttaccaaaagaagaagcggatttaatcagagatcgcgccgtcgtatgtaaacgtttgaatcccattaaaattgaatctatcgtacgtggttatttaactggcagtggtttaaaagattacaaacaaactggcacgatttgcggattaaaattgcctgaaggcttggtggaagcgagtaaattacccgaagctattttcacgccatcaagcaaagaagaagttggcaaccacgatataaatattagctatgccgaatgcgaaaaacttatcggggctgatttagccgcacaagtaaaagaaaaagctatcgcactttataccgtggctgcagaatatgcactcactaaagggattattatttgtgacacaaaatttgaatttggtttagatgaaaatggcacgctcactttaatggacgaagtattaacgccagattctagccgtttttggtctgtggatacttaccaagcaggaacaaatcccccatcattcgataaacaatttgtgcgcgattggttagaaaatagcggctggaataaacaagctcccgcaccaaaagtgccagaaaatattattcagaaaaccgttgataaatatcaagaggcactggatttattaacaaaatgaaaattaggattttttatgcacaaagctaaataaagatttttgcttttaatgcacaaaacactagacaaagaggaaaagtgcggttatactctatagaatttttattcacaaaaatcgattatttattcaattctaattattagtaaggaaaatatatgtcaaatactattctacagaatttacctaaaggacaaaaagtagggatcgctttctctggtggtttagacactagtgcagcattactttggatgcgtcaaaaaggcgcagtgccttatgcttacaccgctaatttagggcaacccgatgaagatgattacaacgcaatccctaaaaaagccatggcgtatggtgctgaaaatgctcgcttaattgattgtcgtgctcagcttgctcacgagggaattgccgcaattcaatgtggtgcattccatatttctacaggcggaattccttatttcaacacgactccacttggtcgcgcagtaacaggcacaatgctcgttgcagcaatgaaagaagatgatgtaaacatttggggcgacggctccactttcaaagggaatgatattgaacgtttctatcgttatggtttattaacgaacccgaatttaaaaatctataaaccttggttagatgtacaatttattgaagaacttggcggtcgtttagaaatgtctcaatttcttattgaaaatggttttgactataaaatgtccgttgaaaaagcctattccactgattccaatatgctcggcgcaacccatgaagcaaaagacttagaacaattaagcacaggaatgaaaattgttaagccgattatgggtgtcgcattttgggatgaaaaggttgaaattaaacctgaaacagtcacagtcacttttgaagatggcgtacctgtggcattaaatggcaaacattttgataatgctgttgatcttattctagaagccaatcgtattggtgggcgtcatggtttaggaatgtcagaccaaatcgaaaatcgtattattgaagccaaatctcgtggtatttatgaagcaccaggaatggcattattgcatatcgcttacgaacgtttagtcacaggtattcacaatgaagataccatcgaacaatatcgtattaatggcattcgcttaggtcgtttgttatatcaaggtcgttggtttgatccgcaagcattaatgttgcgtgaaacagcacaacgttgggtggcaaaagcaattacaggcacagtaacgcttgaacttcgtcgtggtaacgacttcacaattttaaataccgaatcgccaaacttaacctacgaagcagagcgtttaagtatggaaaaagtggaagatgcaccatttgatcctattgatcgtatcggtcaattaacaatgcgtaatttagatgtatcagacacccgaggtaaacttggcatctatgcacaaacaggtttattaagcgcaattaaagattccgtattgccacaattaggcaaaaaataaataataaaatctgcatttcaatgactgatatttaacatcatgaaatgcagatcctttcacaaaatattagttagctaaaaaaactagagatataagaaataatcgtttttccacttaatattgccataataatcacaacaaaccagcctgaaaaagctaaaaaaacagggtgtttataagtgccaacaatatcacttctgtaagcagctaacaaaattaatgccaatgcaattggcaatattaagccatttaatgttcccacaaagactaataccgcagcaggttttcctacagtgactaaaacaacagtagaaatcacaataaaagcaataatccaacgattacgattgcgttcaatggttggacaaagggtcgttaagaaagaaactgaagtataagccgcaccaataacagatgtgacagacgctgcccaaataaccactccaaataatacttgaccaaaattgcctgctacatattcaaaaggcgtttcagctggatttttaggattaagagacacaccttttgacaccacaccaagcaccgcaagaaataatacaacacgcattgttgaagcaattaaaatggctgaaacagaactacggctcacttcagccattgctttttcgccttgaatgcccgcatctaataaacgatgcgcgcctgcaaaagtaatataaccgcctacggttccccccactaatgtaacaatagcaataggatcaatttgttctggaataaaggaatgatacgctgcttcaaccacaggtggttcagttttaaacattacataaaatgtgagcacaaccataataaagcccattaattgcgcaaaacgatccattaataagcctgcttctttacgcaaaaaaatcaaaatagcaataataccactaatcactgcgcccatttctggtgctataccaaaaatagaatttaaaccaagccccgcgccgccaacattgccaatgttaaaagccagcccgcccatcacaatcagcgcagcaagaaaataccctgctttcggaaaaaccgcattagaaatatcttgcgcgcgtttgccagacacaataacaattcgccaaatattaagttgagccccaatatctaacaaaattgataataaaataacaaagccaaaacttgctaataaagtatttgtaaaggttgcggtttgagttaaaaatccagggcctatggcggatgtcgccattaagaaagcagcccctaaaaccgcatttcgtctgtgagtaattgatgccataaagcacctccattgttaagttgatgttatgtgtttattcggcttatgccgttattttgatatgatttttttctaattcttccacaatgcgtttagcaaattgtaaagaatgttgattatcgccgtgtaagcaaatactttctgcttttacaggcacaaggcttccatcaatggcattgacttgcccctttgttaccatttgtaacacttgttgaatggcttccttatcagattccaccattgcatttggttgagaacgaggcaccaaactcccatcaggcatataatgtcgatcggcaaaaacttcagaaatcgtttgcaatttttcttcctctgcgatgcgcaacattaaactgcctgctaaccccattaatttcaaattcggatcaaattgataaacggtttgtgcaattaaacgcgctattttttcatcttttgctgcttggttatataacgcaccgtgaggtttaacataactaattaccgccccctcgccatcacaaatcgcttttaatgcccccaattgataacgcaaatgtgcgattaattcctgtgaagacaacgccattgccgtacgaccaaaattttcgcgatcaggaaaactaggatgcgcaccaatacgcaccttattttctttcgcaaatttgaccgcactttgcatttcctttgcacccccagcgtgtaagccacaggcaacatttgcagaagaaagcaactgcaataaactttcatcaaaaggaaaaccctctgcaatatctgcatttaaatcaatttttttcatcaacaattctcctaatttgatcaaggtatatttcatttttacggcgtaatttagcagcctcttgtaagctaaccgcttcaaatttaatcgttgaacctaaacgtacctgtgccaaagccccaagatcagcatcaatcacattagcgattttaggataaccgcctgtggtttgcgcatcagccatcaaaataataggctgaccacttggtggaacttgcacgctaccaaactgaatggcgtgagatagcatttccaacggctgctttaattctaatgtctgaccttgaaaacgataacccatacgatcactgttactttgcaacgtccattcatttcgccaccaataatattgggattttcgtttaaacgcctgatattcagaagatggcaaagcacgaataacatctcgaagcggaatcggcgcaataccaatttcgctacgcaaaatatgatcatttgccgtttgtagttgatcgcccgcctgcaaacaacgcccctcaatgccccctatttgcgctctcaaatccgtgctgcaagaattcaatgcttgaggcaaaacaaaaccgccttgaacacataaataaccatacattccaatttttgcacgtgccatttttaatatttgacctgctcgcacttgataacgccaataagcaaaaacgggcttatcatctaacatcatttcataaaaagcaccagtcacacaaaaattcatatcttgctgaaattgcaatgtaataccgcctaaaggcacttcaatggcaggaacattctctgcattgcccaataaaatattgcctgcgcgtaatgctaatttatccattgccccacaatggctaatgccaaatcggcgtaaaccaaaacgccctaaatcttgaatggtcgcacgggatttcacatcaagaatatcaatcatagttcaattccctccacaataaatttcacagtatcgccagcttgtaataaagttggttgtgcttgatttttatcaaaaagtgcttgtttagtataaccgatcaactgccacccacctggcgaagnaaaaggataaatccccgtttgcgcccccccaataccaacagaaccagcaggaacaaccgttcttggcgtggcacgacgcggcgtgtgtaaattttcaggtaaaccacccaaataaggaaagcccgcttggaagccaatcatatacacagtataaataggctcactgtgcatctgaataatccgctctggtgttgtctgatgaaatttcgctacatcagataaatcctgacctcgctctcccccataaataacaggaatttcaatatgacgcccttgaaaatccgatactttcaactcagcccaaagttgttctaaacgttgcacaagcggcttaaaatccacgaaaaaatcggtaaaaaccgtaagattattcattcccaagacaacttctacaatatcttgttctgattgcaattgacgagcaaacgcccataattggcgttgttgttgaatggaagctgggggtggcaaagagcaaaccaccgccgattcactgatcggaacgatattcataagataccctttatatgatgttatgtgatttgttatttttttgttacagctctcttttaaaggatatttatagattttgtcaagtctttattttcatctttttaattcaatttaaaaacattacgctttaaccatcaaaaggaaatttaacacaaattcatttggttgaaacaataataccacccataaaaaaagcggcaaatgccgctttttaaaagagataatccaaactttaccactggtaaccaacaccagctgcaacgcctgttttaccttgactattggttgtgcctgacaagcgaataatcactttgccattatcggaaattcttgataccccgatagctaaaccactttgaccttgataactacttcccgcaatagaaaccattgatttacctggcatagaggcttgtggtaactgtgaagccgctaatgcacttgctgtacctgcatctgcacgtttgcccactttattcacttgtccagcaaggtttgttaccccttttgccacggcatacaactggctgccgttaatcgcatctgtggaagtagcggaaatttcgcctgccgcgacgtttttaactgctttattacccgccctaatgccgtctgaagccactttaatcttgtcggcatcagtcgccgccgcaccattcgcaccgtttgccggcgtaaaggtcaagccgtctttggtaatcttcgtgcttgcaccgtttgcaccattctccgtgtctttaaactccacgctctttacgcccgtcaattcatctctgagcacgtaagtgaagtttgtaccctcttgtttgaccttcagattatcgccggctttcaaagttactttatcgcccgacttcactaaagtgtcggtatgcgtgccatcggtcgctcctgtgccgtctttaccaacgcccactttccagcccaatttgttcaggctgtcaaccaattcagaagcctcaaccaaaccggtagttgttttcgcgccgtcttgaatcgtagccttaccatcatcgccaacctgcaccgaaccttttttcggcgtaaaggtaaccgtgtcattttctgctttgatattcaacaactcgccgtctgtggatttaaatttaaaattcaaaccattgcttaaagtttgagttcccttgccgccgtcggcatcgctaccgccattggcataagcattgctcgcacttaacgtaacctgtttgtcttgcaaggctttcaactgcttaaagctgaccgcatcggtatcttccgtgccgtccgcaacattgctgattttcaccggatttgtaccgtttgccgataccaatttcactttagttttcgccagcttgccattttcgacttttttatccatatccgccgaaccgtcttgcttggcttcgtaatactcattgcccactttcacaacggttttgctgtcttccgtaacatattggaccggcaagcctgttacatccacacggacggttgtttttttgttatcatcagtcgtaacgctcacatttgcgtttgcgccgctggcaaattcaacagtgtcataagttgaaacaaaatcaacattatcgactgtaccgccaatcgtttttgcgccacgaatattccaacccgcattcaatacatcgcccacgctcgcagcacggttacgttctgtatcgctgatttcttttgtaaggtgtgctgtttttccacccacacgaggatcatctaaagtcgaagcaataccgtttaagtgaacattaccgttttgaccattcgtacccggtttcgcaaatttcaagccgtttgtatcactggtaatatcgactttattgccgtttgcaccaatcgttaaacgatcactaaaggtcgcagttttcgcttcaaggtttttcgccaagtcaaaagtaatattttttccatcacgtttaactttcaggtttttacctgctttaaaggttaaggtatcgcctgctttaagtgcgtcatctccctgatctttcgcatcagcttcatcaagtgcggtagttaaattctctgttttcacaaaagtcgccgcactattaattgcggttgcaacatcttttacagttgcgactttcttatcagcgtcattagcagtagcatcttttacagttactttaccgcgatctgcatcagtcgctccagttttaacagtttcaaagccacctttagtgacagcagtaccattattaccaacagttaaaacattatcagtgttttgattatccactttgagcttaatagtatcgccatctttttcaagaccgctatccgctttagtttcaaccacactaacggtaatcgtatgtttaccgttttcagatttggaagtaaccgtagcagcaccggctccggtaaagaggacttcatcagcttgtttaacttgattgctttcttctttcgtaccgtttttggttgatactacccaacccaatttacgtaaatcgcctacagtcgccgccgtgctgtcagccaccaacggttgtttatttgcatttttttcatttagatttaataaacctttataagcatcttcaacgtgtctatttaaatcagttgcagagttatttaaaacatcaaaattcgcatcgtcataagctcttaaaccactcgcaacattagtaatagctttattacctgctttaatgccatctttggttacgctgatggtgtttgtacctgtcgtaccgccattacctgctggcgtgatggttaaaccgtctttgttgatgacggttttcgcatcatttccgccattagttgtaccacctaaagtaatgctcgttaaacccgttaaagcatcttgcagtgaataagtaaagttcgcaccatcctgtttcacttttaagttcttgcccgctttaaaggttaccgtttcgcctgctttgacttcttggtcttttgaagtaccctcaagcgcaccatcagtatcagcctcagcttttgctttccaacttagattacctaaagctgttaccaaatcgcctgcattaacaagttttttcttgtcatcttctttagcaatttcagctaccttaccacctgtcacagtaagtgcggtcgtatctgcaacgattttttggtcgccgtcaatcttcaagccgtcgccaacttttgcttcgtatttaacagtaatgccatcagtactattagtcactgacgccgttgtaccattaccattagcaaaggttacatttgtacctgacgcaacagttgcgaagtcgtcattttgaccattagcagtggttgttttaactctccaaccgctcttattcactgcttcaatcacagtttttgcagtgactaagccattgcctcgtctgtatcttcagttgcattggtcgctgtaccagtattcgcatccttcaactgcttacctgtaagcaacttaccattattatctttaataacagaagttttcggtgtgaacttcacttcggttgttttaccgttttctttagctgttaatacaacatcaagtgtgtttttatctcctgtaataaactcaacattgtcataacccgccactaaatcaacattctcggtattaccccccgcaactttagctcctttaatattccaacctgcatttaaaacatctttaatagttgcagctcttgttttttcaatgtcactaggcgaaaaggttactgaagttgaggcacctgtatttgtagtcacatcaggcaaagttgaagccaagccattcaaatgaactgcagtatctccattagtgccttttgctaacttcaagccatcagccgtgctagtaatacttacttttggcgtagcaccacccgcagcaggcgtattcccgccaatcgttaaagtatcactcactttcgcggttttcacatcaaggtctttcgctaaagcaaaggttactgatttaccaccttggtctaacttagcttttaagtttttacccgcttttaaggttaaggtgtcgcctgctttgagagcttggtttttattgtcatctttggttgcagcactatcttcaatatcatcttccgtactttgcactttcacgaaagttcctgcgtcgttaatcgcctgaaccgttgcagacaatacggtcgccaatacggcggttgccacggttgcggaggtgcgtttggtgtgggcgcgagtgagttcagacaccacaacccaagtttgagtcacaacattccaaataactttaaaaattttattcatttttatttaccctatatttaataacattaatagtgactacactttccttagtgaaagtgtgcgaattttattttatatttggagaataaaaaagtgatattttgcgaaaagtttagcctcaaaaaaaatagaaaaaacaaacagttacataaaaatcaaatctttttagataagttaatttattttttatttaaaataaggtttaggtttgtttatcttttatttctttttagcaagaaaaaagattaatcttgacccattttaggtgttttttgttgaaaagtgcggtaaaaattaaaagaaaaacctgctttctggcattgaaagcaggttttaggcaaaagggaacggcaatttattgaagtatttcgcccacaatactgcgtgtggcttctttcacttctgtgagtttcacttttaccatgtcgcctattttgtaagtgcgttcgccttttatatagagggcaagttcgtcagggtttagttgtatttcttctttgttgttgtgcagcgtggcggcaggaataaatagcgatgcaccattttcgagcagttgtacgcgtaagcctgcacgcattacatcttgcacttccgcctcaaattcagcatttgatgccactttgtcagcaagataacggcaatatagccaatcggcaatatcacgttctacgaggcgattttggcggcgagcctcttgcaaacgtgccaacacgtcattttgtggtttttcataaggctgttttgccagcacggctttgattaagcgatgattaaccatatctgaatatttgcggatgggcgatgtccaagtggcgtaaccctctagccccagcccaaagtgcggtgctaattctgatttaaattcggcgaaagttaaataacggcgtaaacgcagttctaaataatcgctttcgatgggttcaatatcgtggcgcatttggcaatagccgtttaaggttgctaagttttctactgaataacgttctgccagttcagtttgattttgttcattggctaaatttgccattaagaaattgtgtgcgttctctaagaattttttatcaaaaccgctatgggtgttgaaaatgcctgtttttgcctgtycgtgtaaaaattgggcggcgcagatgttggcaataatcattgcttcttccacaatttgattggcaatacggcgatattctgctttgatttcttgtactttgccgttttctgccagcacaaaggcataatcgggtttttctttaaagaataaggaatgggttttgcgccattgaatgcgagctttggtaaattgatgtagccagtgaatttgttgtgctgtttctggcatttctggctgccatgcattgtctgcctgttctaaataatccgacactttgttgtaagccagtttggctttagattgaacataagcggaaacaaaatgcggtttggctgtgatgttgcctgtaagatcggtttcgatataacagacaagcgcggggcgggtttcattggcgattaaggaacataattcatcagataattcacggggtaacattggaatgttaaagcccggtaaataatttgtgaagcaacgctgtttggcttcttgttctatttgagaatctaaggcgatgtaagcggttgggtcagcaatggcgaccactaatttccagcctgtttgtgtgctgttttgtgctatgggttcgatatataaggcgtcgtccatatccattgtgctttcggaatcaatggttacaaaatgaagtgcggtcagattttcgcgtgttttttgatctaacatttcataaggttctgcgcctcgcacgggatagcgcgattgttcgtggcgtgccaatgtgacccaccaaggggctaattcatcgtcagctcggcaaataagttgattaattgtggcgtagaaaaagcgatcgtcacgtaatggatgggtttttaaatttgcgacgacccagtcgccctcttgcaattcttcttttaccgatttcgcctgttgtgcgccaatgggttgattaatacttgggtgatccaccagcacttgtaatttcttgtctttattgaaccgcacttttgcgataaaacgtgtgagcattggctcaattaaggcttctggctcggcttgttctttgtcgccttgtttttcaatagtggctttgattttgtcgccatgcatcacttttttcattgatggcggtgcgatgaaataggtttttttatcgcactctaaaaaaccgtaggctttatctgtgctttttaccacgccctcaacctgttctttgctgtcgtggatttgttgtttaagttgtgcgagtagaggattatcttgaaacatagttattttgaaacatcgttattattttaaaaaagagaaaaggcagactgaaaagcctgcctaaaaaagaatgtaagaaaaattattcttcgcctaattcgcccattgcagtaatgctgaaacctgcatcaacgtgaacgatttcgccagtaatgccagaggctaagtcagagcataaaaatgccgctgagttacccacatcttcgatagtgacagtgcgacgtaatgcggcggttttttcaaaggtggaaagcattttcttgaagtttttaatgcctgatgcggctagggtgcggattgggcctgcagagattgcattcacacgaataccttctttgcctaaatctgctgccattacgcgtgttgcggcttcaagagaggcttttgctaggcacattacgttgtagttaggaattgcgcgctcagcacctaagtaagacaacgttaataatgcagcatttggatttaagtaaggacgtgccgcttgtgccattgccacgaagctgtatgcactaatatcgtgagcaatacggtagccttcacgagttgccgcatttacgtaatcgccgtctaattgatcacctggtgcaaatgcgattgcgtgaataaaaccatcaaatttatcccaacgcttacttaattctgcaaagcagttttggatgctttcatcggttgccacatctaaaggaagcacgatatcagaaccaaattctttggcaaattcttctacgcgcggttgtaatttatcgtttaaataagtgaaagcaagttctgcgccttgttctttcattgattttgcgatcccgtaagcaatggaacgattgcttgcaagacctgtgactaaaatgcgtttacctgttaagaaacccataatttttcctatgttgttagcgtaaaaaacttgcgtagtataagcgaaaatttgtctttgtacaaagccgaccaatatttctaagaaaaccaaccgcactttatttgcaaattcgtttgagcaaaaacctaaaatcagggaaaatagtccacatttttaattgaacaaagaagaaacaatgagttatccattagaagaagttaataaacgtcgcacttttgcgattatttcccaccctgatgcgggtaaaacaacgattactgaaaaagtacttttatacggcaatgcaattcaaactgcaggttctgtaaaaggcaaaggttcggcggctcacgcgaaatctgactggatggaaatggaaaaacaacgtgggatttcgattaccacttctgtgatgcaatttccttataatgattgtttagtgaatttgctcgatacccctggacacgaagatttctctgaagatacttaccgcactttaaccgctgtggatagctgtttgatggttattgactctgccaaaggggtggaggaacgtacgattaagttgatggaagtcacacgtttacgtgatacgcccattattacgtttatgaataaactcgaccgtgatattcgtgatccgatagaattgttggacgaggtggaaaatgtgttgaaaattcgttgtgcgccaattacttggccaattggctgtgggaagttgtttaagggcgtttatcatcttgcaaaagatgaaacctatttatatcaatcagggcagggttcaaccattcaggcagtgcgtgttgttaaaggcttgaataatcctgaattagatgttgctgttggcgatgatttagcacaacagcttcgtgaggaattggaattggtgcaaggcgcaagtaatgaatttgagcaagatgcctttattaagggcgagcttacccctgtatttttcgggacagcattaggcaattttggggtggatcattttcttgatggcttaacacaatgggctccgaaaccgcaatctcgtcaagcggatacaagaacggtggaaagtgcggaagaaaaattcagtggttttgtgtttaaaattcaagctaatatggatcccaaacaccgcgaccgtgttgcctttatgcgtgtggtttcgggcaaatatgaaaaaggcatgaaactaaaacatgttcgaattggtaaagatgtggtgatttctgacgcactcacctttatggctggcgaccgtgctcacgccgaagaagcttacgctggtgatattattggtttacataatcacggtacgattcaaattggcgatacgttcacgcaaggcgaaacgctgaaatttacaggcattccaaattttgcaccagagttgttccgtcgtattcgtttgaaagatccgcttaaacaaaaacaactgttaaaaggcttggtgcaactttctgaagagggtgcagtgcaagtgtttcgtccattattaaacaacgatttaattgtgggggctgtgggtgtgttgcagtttgatgtggtggtttcgcgtttaaaaactgaatataacgtggaagcgatttatgaaaatgtgaacgttgccacggctcgttgggtggaatgtgccgatgagaaaaaatttgaagaatttaaacgcaaaaatgagcaaaatttagccttagatggcggcgataatttaacctatatcgcgccaacaatggtaaatctaaatttagctcaagaacgttatcctgatgtcgttttttacaaaactcgcgaacattaaaatgacaaagtgcagtaaaattctaccgcacttttccagaaaaaaagcgttgaaatttaattcaacgcttttcttttatttagagagattttcttgttttaatcgccaaagttgataaatatttaccacaactaaaaaggcatttaataatgcaacagggtatgctgtgataattaggctgtaaataacaaataaaatcgcgccgatactatttacaatgcgtaaatgcacaatagatttaaataaaaaagatgcagcaacaaaaaaagtcgccatataacctaaaaactcaataaaattaaagtccattattttgttctctttgattaaaaataaaaacggtgggtatgataaaagatttttaacgcaaggmaaagataagaaaaagaagcaaccgtttgcaagggaaaattatataaaaataagttgaacaagagccatatagaaaagtgtgcctacggcaatagatagaaacatatttttcttccagaaatgtaagccaagcacgactatccctgcaagcaaatcaggaatgccgtgatagccagttaaaatctcaatatttttatagcaataaacgacaagcataccaaacattgcagggggtaaaacttttccaagataacggatatattgtggaatggggcgattaacaggaaatacaaaaaatggtaataaacgtgtaaattgtaccgccactatacaaattccgatggtaatgatttgttctattaatgtcattttaaagattccaattttgtttctaatttagttatgcgcatagttagaattaaccaaatgccaattaatgttggaattaaaaaatattcttttcctataataagtaaaaaaactaatgcgatgcctaaacctaatagagagctttcgtgggattttccttttaaccaattttctgcaaaaataactaagaatagtgctgtcattgaaaattccacaccttttaaattaaaaggtaaaacagtaccaaataaattccccattgctgcgccaagtacccaataaatatgcaaatataagctcacaaaaaacatataccagcctttatctaagtgcggtgggatttttgccatataatttagggaaaaagattcatctacaagtgttgtgattaaataccagcgtttttttcctatatgtatgccatatttttctagcattgatataccataaaaaatttggcgggcactaatcattaaggtaattaataatacgctgattggagagaaaggtgcaataagtgcgcctgctgcaataaattcaacagaacccgcataaataagtaaagccatcaaagtaggatataaaaatccgaaaccaagtgctttcatataaataccgtatgctatgccaagaaataaaaatcctgcaatcattggtacgctgtagggaaaagtagccttagccgcttcagtaattgggttagagtgttgattttgttgagataaattcattaattatgtctataaatttaaaacagaaagtccgggtaaagttgagaaactttgagatttgactgtttgataaaaatcttctaaataagaaagggattcatcttctttgcgaatcgccgcatatagattgctatataaaccttcttttgtgacttttcttgccacgacataacccttttccaaataaggcagcgcagcccaataagggatagtcgcaataccacgacgactcgcaacaagttgaatcattgcaatagtaagttctgttgtacggcgagtaggattaatgccttttgatttaagcactttacgccatagatctaacatatcgtcaggtacggggtaagttacccaagtttcatcaataaaatcttccgcttcccaaatatctttttctgctaaagaatgattttttgagcaaatcccaaccatttcataagaaaagagcggtttaaaaatgacatcatcattatgctctatttctgatactatcgcccaatctgctcgatgggaaagtaataaaccaacgggatcagtatgaaagccagatacaatatccagttctactagcccccaatgctgacggaattcatccatcgctggcattaaccaatcaaaacaagtatggcattccaccgctatacgtaactgtcctgcatcgccgtgttttacccgtgcaagatcacgttcagcatcaatcactttcggcattacttcattcgcaagacgaattaaacgctctcccgctgaagtaaaacgaagtggattacttttacgctcaaataaaggcaagccaaattgttcttctattaatttaatttggtgagaaagtgctgattgggttagatatacgcgctttgcagctagagaaacgctgcctgtctcttttaaagccaataaagttttaagatgtctaaattctagaaaggttggtttcattaataatattcatataaaattaagaattagggaaccagtataatacattaaaattagaaatatgctaattaataaaattaattatttagataattattttagttaaaatacaaaaccccagtccttaaactggggttctatatttattctttatctaatttgtttaattctgtttttacttaacttaatttaattttatctatcttagatagatttatatttagattttttatttgataacctggcggtgccctactctcacatggggaaaccccacactaccatcggcattacagcgtttcacttctgagttcggtatggtctcaggtgggtccaccgcactatcgccgccaggataattctttgataactcgtcttttctcttttatctctcgtctcttttatctctcgttactcagtctttcctctacctttcactcgttcttattggtcacaagctgaatccgattttctttctattaagtcttctatatttacttttctttgtttagtcttttacttctctttcgctctgcttttatttgcttcgcttttcatctcttacttcacttagctcccaaaaacacttgagcgttgtatagttaagcctctcgggcaattagtattggttagctcaatgactcacatcacttacacacccaacctatctacgtcgtagtctacaacaacccttactgacttaaagtcagggatgactcatctcttggcaagtttcgtgcttagatgctttcagcactttatctcttccgcatttagctacccggcaatgcgtctggcgacacaaccggaacaccagtgatgcgtccactccggtcctctcgtactaggagcagccccaatcaatcatcctacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctactttcgtacctgctcgacttgtctgtctcgcagttaagcttgcttataccattgcactaacctcacgatgtccgaccgtgattagcaaaccttcgtgctcctccgttacgctttgggaggagaccgccccagtcaaactacccaccagacactgtccgagaccacgtttcgtcatcttcgttagaacatcaaacgttaaagggtggtatttcaaggtcgcctccacaatgactggcgtcactgcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggtgcttctctttcgatgacaccatcaattaaccttccagcaccgggcaggcatcacaccctatacgtccactttcgtgtttgcagagtgctgtgtttttaataaacagttgcagccagctggtatcttcgaccggttcaaccttcaggggctagcccttacaatctacgccggcgcaccttctcccgaagttacggtgctattttgcctagttccttcacccgagttctctcaagcgcctgagtattctctacctgaccacctgtgtcggttttcagtacggtttagtaaagcctttcgcttagtggcttttcctggaagtgtggtatcagttacttcagctccgtagagcctcgtcatcatctctctgtgttaaggaagtccggatttgcctaaacttcccacctaccaacttaaacgcacatatccaacagtgcgataacctaacctactccgtccccacatcgcagctttaccaagtacaggaatattaacctgtttcccatcgactacgcttttcagcctcgccttaggagccgactcaccctgccccgattaacgttggacaggaacccttggtcttccggcgaacgggtttttcacccgttttatcgttacttatgtcagcattcgcacttgtgatacgtccagcccacctctcgatgaaccttcttccgcttacacaacgctcccctacccaacagaataaattctgatgccgcagcttcggtgctatatttcagccccgttacatcttccgcgcaggccgactcgactagtgagctattacgctttctttaaatgatggctgcttctaagccaacatcctagctgtctaagccttcccacttcgtttcccacttaatatagacttggggaccttagctggcggtctgggttgtttccctctccacgacggacgttagcacccgccgtgtgtctcctgagtatcactctttggtattcgtagtttgcatcgggttggtaagccgggatggccccctagccgaaacagtgctctacccccaaaggtgtcacctcaaggctctacctaaatagatttcggggagaaccagctatctcccggtttgattggcctttcacccccagccacaagtcatccgctaatttttcaacattagtcggttcggtcctccagttagtgttacccaaccttcaacctgcccatggctagatcaccgggtttcgggtctataccttgcaactattcgcccagttaagactcggtttcccttcggctcccctattcggttaacctcgctacaaaatataagtcgctgacccattatacaaaaggtacgcagtcacaaggttgccctcgctcccactgcttgtacgtacaaggtttcaggttctatttcactcccctcaccggggttcttttcgcctttccttcacagtactggttcactatcggtcaatcaggagtatttagccttggaggatgggccccccttcttcaaacaggatatcacgtgtcccgccctacttctcgttagcttagtaccacaatatggtttttagatacgggattatcaccctctttgattgtgcttcccaacacattctcctcactatattgctatcacttactggctctttcgctttcgctcgccgctactgacgaaatctcggttgatttcttttcctcggggtacttagatgtttcagttctcccggtttgcctcaacaagctatgaattcacttgttgatagtagattcttcatctactgggtttccccattcggatatcttggattaaacgcctcttatcgactcatccaagcttttcgcagattagcacgtccttcttcgcctctgattgccaaggcatccaccttgtacgcttagtcacttaactatacaacctcaaatgttttcaatcactttacgttttcacttcaaagtgcggtcaatttgatgcgtattttcattcaactaaacacttgattgcttttgttcaatcaagatttttttacaaaacaggttttgtttttagagtttccttttcagttctctctttcactttactgttttgcctactcagactttctctcgaaaatctcttgttttcagcttgtttccaattttttaaagaacagttgataaaacttttcagttatcatcgttaaataaactaaaacaaaattaaatttaaaattaaacttaaaactaagaataaaataacctaatatttaaaatagcttaatcactaccttaatactttattaatttgtctttttctaatttacttaacaatgataagtggtggagataagcgggatcgaaccgctgacctcctgcgtgcaaggcaggcgctctcccagctgagctatatccccatttcatcataatttaataactaatcatttatgtcttagttattatttatttacactacacctttcgtttcactcactctcagagtggtgggtctgagtggacttgaaccaccgacctcacccttatcaggggtgcgctctaaccacctgagctacagacccaagggtaatgttttcttctgctcatttgtctacaactatcagccaatctgtgtgagcactcgctgtctctcgtcttcagtaaggaggtgatccaaccgcaggttcccctacggttaccttgttacgacttcaccccagtcatgaatcataccgtggtaaacgccctccaaaaggttaagctatctacttctggtacaacccactcccatggtgtgacgggcggtgtgtacaaggcccgggaacgtattcaccgcgacattctgattcgcgattactagcgattccgacttcatggagtcgagttgcagactccaatccggacttagacgtactttatgagattcgctccacctcgcagcttcgcttccctctgtatacgccattgtagcacgtgtgtagccctactcgtaagggccatgatgacttgacgtcatccccaccttcctccagtttatcactggcagtctcctttgagttcccgaccaagtcgctggcaacaaaggataagggttgcgctcgttgcgggacttaacccaacatttcacaacacgagctgacgacagccatgcagcacctgtctctaagttcccgaaggcacaagctcatctctgagctcttcttaggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagctacgggcaccaagctctaagcccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttacccagtctgaaatgcaattcctaggttaagcccagggctttcacacctcacttaaataaccgcctgcgtgccctttacgcccagttattccgattaacgctcgcaccctccgtattaccgcggctgctggcacggagttagccggtgcttcttctgtatttaacgtcaatttgatgtactattaacacatcaaccttcctcaataccgaaagaactttacaacccgaaggccttcttcattcacgcggcatggctgcgtcagggttccccccattgcgcaatattccccactgctgcctcccgtaggagtctggaccgtgtctcagttccagtgtggctggtcatcctctcagaccagctagagatcgcaggcttggtaggcatttaccccaccaactacctaatcccacttgggctcatcctatggcatgcggcctctcagtcccgcactttcatcttccgataatacgcggtattagcgacagtttcccgtcgttatccccctccataagccagattcccaagcattactcacccgtccgccactcgtcagcaagaaagcaagctttctcctgctaccgttcgacttgcatgtgttaagcctgccgccagcgttcaatctgagccatgatcaaactcttcaattcaagttcaatcgctcaataaactgcttagctataaataaaatactacttaaaaaagtaataatgaattttcagttaagcacctattaagacttcaaaattaaaaatagttttaaaacaagtcaatcaacaagtgcccacacagattgtctgatatattgttaaagagcaaaaaataacgacgcacttggaaacttaaaaaacttcacaacagtgcgtcgttgtgtgcggtgcattatagggattttcaaatcccttgcaagtactttttgcaaaaatttttgaaaaactcgaccgtttgttgaaaatacatacgtaaaatacataattccgccaacaaatggttgatttttgatctcaatttataaattaaagtttacttagatcaaccaaagcctctggtttaatatcggcaatagtacgattgctggttaatgtcatcgctacgtgcatctcttttttgaaaatgtcgagcatattttcaacaccttgacgaccttctgcccctaaagcataaacaaatgctcgacctaacattgttgcatctgcccctaatgccaacatacggactatgtctaaaccattgcgaatacctgaatcggcaataattttaatatcccctttcactgcatcggcaattggtggcaacgctcttgcacttgaaagcacgccatctaactgacggccaccgtgatttgaaacaacaattccatcagcaccgaaacgcaccgcatctttcgcatcttcagggtcgagaatacctttaatgaccattggaccttcccaaaactcacggatccactctaaatctttccacgaaattgatggatcaaagttttctgttagccagccaatatagtcatctaaacctatttgtctacccatataagttgaaacattacccaaggtgtgcggtttgcctttgatacccacatcatacgcccagaatgggtgtgtaaagccttgtaatacacggcgaatttctttgtaaggcccgctcatacctgagtgcatatcacgataacgtgcacctggagtaggcatatcgaccgtaaacactaaagtagaacagcctgctgctttcgcacgctcaagcgcgtttttcataaaaccacgatcttttaacacataaagctgaaaccacattggacgcttaatcgcaggggcgacttcttcaattggacaaattgatactgttgaaagggtaaacggcacacctttattgtccgccgcttgtgctgcttgtacttctccacgacgcgcatacattccgcacgccccaactggtgcaagaatagttggcattgaaagtttttcaccaaataattctatactagtatccaattcagacatatcttttaagacacgttgtcttaaagcaatattttccaaatcactcacattacgcgcaagtgtttgctcggcataagaaccgccatcggcataatggaacataaagggaggaacacggcgacgcgccgcttcacgataatcgctagctgatgaaataatcatttttacctcttattcaataaaatagtgagaaacctgagaggtattataacactattttaacaaattcaataaaaatcataattattttgagaactagatcacaatttattttaaaaaagtgacatatagaaatgatataagtagaaaaatcacctataaaattaggaaaaattgtgaatttatcaatatcacacaattaatctattaacttttaatctattttgattacttccaaagattcaaatccccatagatgtaaagcttttttaaattgagattcttcgggaaaatgtgcggtgcaaaacatttgattatatttttcattttgcgcttgtagatttttatcatcaagtaaatatttgatccgtttagcaattgctgcgctcggttccataaaatatttaacttgtggcaagcataactgaatttcatctttgatgagaggaaagtgagtacaacctaaaactaatgtatccaaatctgccatgcctgcccacgaagataactcatcttttaaactaatgagatcaacggaatgaccacgaattttttgctccgcaatttcgactaattttgtcgttcccagtctctcaacaatacaatcttgcgcaaatttatcaatcaactcatcgatataatgacgttttacagtcccctttgtagctaataaaccaatatgttttgtctttgttatttctgatgcaggtttaatagcgggtacagtcccaatgataggaatatcaaaagcagctcgcaaaggcggaagcacaacagtactcgctgtattgcaagctatcaccattgcatctaatggataacgttgattaataagctgacacgccgctaaagttcggtgaataatactttcttctttgcgttctgaataagggaatcccgcattatcaaagcaatagagataatgccaattgggtaatagttttttggcttcacggatatacgctaaacccacccactccagaatcaaaaaagagcactgttgggcgtttttcttttttatccatttaaaactctttgaaaattgaccgcacttttaagcgttcgagtaaatttctttattattgagccagcgacggattaggctttctgccacatcagggtatttttggataagtgatttcgcataatgttgcaccgttggtatcattttnctatctcgcattaaatttgctactcgcaattcagcaattcccgtttgtttcgttccaagtacttcacctggcccacgaatttctaaatctttttccgaaataacaaacccatcttggctatctcgtagcacctgcaagcgtttttgtgaaactttacctagcggaggtttatacattagtacacaaaaagaagccgtgcagcctcgaccgacgcgccctcgtaactgatgaagctgcgataaacctaaacgttctgcattttcgataatcatcaaactcgcattcggaacatcaacacccacttcgatgactgtcgttgccaccaataaatccaattctgcatttttaaaacgcatcatgacatcttgtttttcttggggtttcatgcgcccgtgcactaaaccaatatttaacatcggtaacgctttcgttaaatcttcccaaatcgcttcagctgcttgagcttctaacacctctgattcatcaattaacgtacacacccaataggcttgacgtttttcattaacacaagcgttttttacacgcatcacaatttcagctcgacgttcttcagaaaccactacggttgttatcggcgtacgacctggaggcaattcatcaataattgatgtatccaaatctgcatatacggtcattgccaacgttctcggaatcggcgtggccgtcataattaactgatggggataaaatcccgctttttcgcctttttcacgcaacattaatcgttgatgcaccccaaaacgatgttgttcatcaataatcactaatgctaagtcggaaaactcgacttcttcttggaataaagcatgcgtccccaccaccatttgcaccgcgccagttttgattttttcaagctctgcttgtcttgattttccttttactttacctgccaaccagccaacttcaataccgaaaggcttaaaccaccgtctaaaattattcgcatgctgttctgcaagaatttctgttggcgccattaaggcgacttgtttgccattatcaattgcagttaaagcagccaatgcggcaaccaatgtttttcccgagcccacatcgccttgcactaagcgcatcatcggataatctttgataagatcttgttcaatatcggacactactcgcttttgcgcattagtgggttgaaatggcaaggtggctaaaaatcgctgtttcaaatctgtttgataatgtagcggtaaggcagaaaattgttgcgttcctaaccgcactttttgcatagctaaattatgtgccagaagctcttcaaaaattaatcgttgttgtgcaggatgcttaccttgctctaacatttctaatgaaatatctggcggcggacgatgcaataatcgcaatgcctcttttaagctatattgatgtggattaaattcattaggcaaaatttctgcaatctgaactttgtcgagtaatgccaaagcctgatccgttaattttcgtaatgaattttgttttagcccttccgttgtggaataaatcggcgttagggtttcttccaatactatgggcgcattatctcgcacaatttgatattctggatgatgaatttctggcatgtgacgcccacgtttcacttcgccaaaagcctttactcgcacgccaacttgaaaactattacgcattcccgcattaaaattgaaaaaacgtaacataattttcgatgtgccgtctgacaaacttaccgataaaatcgggcgacggccaaaagcgacttcacaggtttgtacaattccttcaatggtaaaatattgttcggggcggagattagcgattagcgtaattcgcgtacgatcttcatagcgaataggtaaatgaaagagtaaatcttgcagattatgaatgccgattttagccagtttattagaaatggcagcccccacaccagaaaggctggtcaaaggcacggcatcgagaagttcaaggctcatagctcattaatattgcgtttgacattaacgacgccagtgatgcctttaatacgatgaacgatattggcaaggtgtttgatatcttttacacaaacctgcaaaatcacaagcaataaattgttctctaattcttccgtccaaatattttggagactgctttcgctcgctgaaattgcggtcattaaactaagcaaggcattctgctcattcaatatttctatttgtaattcagcctcaaaattcaccgcactttgaacgttatcccacttagccaacgattgacgacaagcatttttcaaacttgcacaatgttgatggtgtaccacaactgtatttttttctgtacaacatcccacaataggatcacctaggattggatggcaacattgagcaaattgtgttttacccacttgcattggtgcaatagtgagtatttttgattcaaattcgagattcttagtattagcagattctaacggcacgcccacaaattgatgcgcaatcatggaggctgactgattacctaaaccaatttctcgtaataattcatctaaagaagaaagggctaaagcatctaatacagttctaatttgttgaatagaaaaatcacctaaattatgcggctgtaatgctacattaagctcaacttcgcctaatttcaccgcatcctcttcacaacgctgtttgagataatggcgaatccgtgttttcgcacgagccgttaccacaaaatttaaccatgcgacttcaggatgcgcatttggatcagtaatgatattgactgtttgccctgattcaagggcttttgaaagtggataaggtttatgctcaacggttacgccaacacaagtattccccacatctgaatgcacagcataagcaaaatctactgctgttgcgcccattggcaattcaacaattcgaccttttggcgtaaaaacataaatttctttcgggaaaaactctgattttacattctcaataaactcaaacgaattacctacactttgttgaatttcaaccaaactttgcaaccagcgttgtactcggatttgtgcggttgtactgtcgtttttaccattttctttataaacccaatgcgcagtaatgcccatttcagcgacttgttccatatcctcagtatggatatgaacttctacgggaacacctttcggcccaatcattgaagtttgcaaagattgatagccatttgctttaggtaccgcgatataatccttaactcggcctggacgtggcttataaagattatgcatttgccccaaaacgcgataacaatcatcaacatttttcacaatcacacggaacgcataaatatccataatagagtggaattcttgatcctttatgcgcattttttgatagatcttgtaaagatgtttttcacgtccccacactcgggcaaaaatgcctgagttttctaaccgcactttaatctcttgtgaaatacgttcgattaaatcttgtcgattactccgcgccacatcaacgagtttttttaacacctcataacgatgtggatgcattgcttgaaaagataagtcttctaattcatttttgatatgctcaatacctaaacgatgagcaagcggacaatagatttcaagcgtttctttcgcaatacggcgacgtttatctggtcgtaacgaaccaagcgtgcgcatattatgcgtgcggtcagcaagcttgattaacacaacgcgaatatcacgcgtcatcgccaaaatcattttgcgaaaattctcgacttgtgcttcttggcgagtacgaaatttcaacttatcgagttttgatacaccgtccacaatttcagccacactggcaccgaactcttctttcagttgttcttccgtataaggtgtatcttcaataacatcgtgcaaaagcgcagccattaccgcttcgtgatctaagtgaagttgagcaataatggaggctaccgccacaggatgggtaatgtaaggttcgccgctggagcgaaattgtccttcgtgcgcatctcttgcaatcacaaacgcacgcttgatgagttcaattttatctgcgggcaaatacccttgaataattcgatctaaatccgcaaacagttccaaaggagacctacttatcgttgaaaaatatcgcctagggtaagtagaccctagcttaactaaatgttaccctttggggtagaaattacgttccccaaagggggacaactataaccataattaaccgtgggtatacctacccgcggtaaaatacctttattttttaccgcacttttaaaagattattctgtaattaatgcaacagctgcttcttccgtttcttgcactttcgccattttttggaantcttgtgcatccataatatcttgattaatcaaacctttttcgatttcacgtaatgcgattactgttggtttgtcattatcttctggcactaatggtgcactttgattaagttgtaattgtcttgcacgacgtgcagccgttaaaattaaatcaaaacggttaccaattttttctactgcatcttgcacagtaacacgagccataatttactccgatttgtcaaaaattactctattgaaagggcgttataatactcaatttcgccctattttgctagtagctgttgaattaacattgcattttgtttttgttgataatctttagttaagcgttccgattgcaaaatactttgtaaatcttttaatgttttctcaaaatcatcattcacaatgacataatcatattcgtcataatgcgaaatttcactcatcgcttttgacattcgttcagcgataacctcttcactatcttgccctcgaccaattaaacgacgctctaattcaggcaatgaaggcggtaaaataaaaatgctttttactgaaggcacttttttacggatttgttgggcgccctgccaatcaatatctaaaaatacatcaatgccttttgctaaattttcctcaatcgcaggtaaagaggttccataataattgccaccaaaaactttggcatattctagaaataaatcttgctcaatgagtgattcaaactcttcttttgatacaaaataatagtgtacgccttcaacttcacccgggcgtggggcacgggtcgtatgtgacacagaaaccattttttgagttgagctatctgatgccaataacgctgaaattaatgaagattttcctgcgccacttggtgcagataaaatataaagattaccttgagacatagaatatttaaccttctctgacaatttcagtctattatgcagatttctctataaaaaatcatcaaaagtgcggtgattttttwcggtactttttcattctaatgatgatttgatatagatcacaaaaaagtagtagggtttatagttttataaaaatgctcgtgctatactctgtgcgttgtcttactgagtgagcagtattactcaaagcaaacagatttgtttaacttaaataaaaggtgaaaatcttatggcaattaaaattggtatcaatggttttggtcgtatcggccgtatcgtattccgtgcagcacaacaccgtgatgacattgaagttgtaggtattaacgacttaatcgacgttgaatacatggcttatatgttgaaatatgattcaactcacggtcgtttcgacggcactgttgaagtgaaagatggtaacttagtggttaatggtaaaactatccgtgtaactgcagaacgtgatccagcaaacttaaactggggtgcaatcggtgttgatatcgctgttgaagcgactggtttattcttaactgatgaaactgctcgtaaacatatcactgcaggcgcaaaaaaagttgtattaactggcccatctaaagatgcaacccctatgttcgttcgtggtgtaaacttcaacgcatacgcaggtcaagatatcgtttctaacgcatcttgtacaacaaactgtttagctcctttagcacgtgttgttcatgaaactttcggtatcaaagatggtttaatgaccactgttcacgcaacgactgcaactcaaaaaactgtggatggtccatcagctaaagactggcgcggc

What is claimed is:

1. A method of producing a sub-population of labeled nucleic acids, said method comprising:

obtaining a sample of nucleic acids from a physiological source; and generating a sub-population of labeled nucleic acids from said sample by contacting said sample with a pool of a representative number of at least 50 distinct gene specific primers under conditions sufficient to enzymatically generate a sub-population of nucleic acids, wherein each constituent distinct gene specific primer of said pool has a nucleotide sequence that is complementary to a distinct mRNA and wherein each labeled nucleic acid is generated using a single gene specific primer.

2. The method according to claim 1, wherein said sample of nucleic acids comprises mRNA.

3. The method according to claim 1, wherein said pool comprises at least 75 distinct gene specific primers.

4. The method according to claim 1, wherein the labeled nucleic acids are first strand cDNA.

5. A method of producing a sub-population of labeled nucleic acids, said method comprising:

obtaining a sample of mRNAs from a physiological source;

contacting said sample with a pool of at least 50 distinct gene specific primers, wherein each constituent distinct gene specific primer of said pool has a nucleotide sequence that is complementary to a distinct mRNA to produce hybrid duplexes between complementary gene specific primers and mRNAs present in said sample; and enzymatically extending said hybrid duplexes to produce said sub-population of labeled nucleic acids wherein each labeled nucleic acid is produced by enzymatic extension which utilizes a single gene specific primer.

6. The method according to claim 5, wherein said pool comprises at least 75 distinct gene specific primers.

7. The method according to claim 5, wherein the labeled nucleic acids are first strand cDNA.

8. A method of analyzing the differences in the RNA profiles between a plurality of different physiological sources, said method comprising:

obtaining a sample of ribonucleic acids or nucleic acid derivatives thereof from each of the distinct physiological sources;

generating a sub-population of labeled nucleic acids for each of the different physiological sources by using a pool of at least 50 distinct gene specific primers, wherein each constituent distinct gene specific primer of said pool has a nucleotide sequence that is complementary to a distinct mRNA and wherein each labeled nucleic acid is generated using a single gene specific primer; and comparing the populations of labeled nucleic acids for each physiological source to identify differences in the populations.

9. The method according to claim 8, wherein the comparing step comprises hybridizing the labeled nucleic acids for each of the distinct physiological sources to an array of probe nucleic acids stably associated with the surface of a substrate to produce a hybridization pattern for each of the different physiological sources; and comparing the hybridization patterns for each of the different physiological sources.

10. The method according to claim 8, wherein the labeled nucleic acids are first strand cDNA.

* * * * *